(12) United States Patent
Brown et al.

(10) Patent No.: US 9,206,420 B2
(45) Date of Patent: Dec. 8, 2015

(54) METHODS AND COMPOSITIONS FOR THE SPECIFIC INHIBITION OF HIF-1α BY DOUBLE-STRANDED RNA

(71) Applicant: Dicerna Pharmaceuticals, Inc., Watertown, MA (US)

(72) Inventors: Bob Dale Brown, Millington, NJ (US); Henryk T. Dudek, Wellesley, MA (US)

(73) Assignee: Dicerna Pharmaceuticals, Inc., Cambridge, MA (US)

( * ) Notice: Subject to any disclaimer, the term of this patent is extended or adjusted under 35 U.S.C. 154(b) by 64 days.

(21) Appl. No.: 13/942,014

(22) Filed: Jul. 15, 2013

(65) Prior Publication Data

US 2013/0303593 A1    Nov. 14, 2013

Related U.S. Application Data

(63) Continuation of application No. PCT/US2012/022045, filed on Jan. 20, 2012.

(60) Provisional application No. 61/435,304, filed on Jan. 22, 2011.

(51) Int. Cl.
*C12N 15/113* (2010.01)
*A61K 48/00* (2006.01)
*A61K 31/713* (2006.01)

(52) U.S. Cl.
CPC ............ *C12N 15/113* (2013.01); *A61K 31/713* (2013.01); *C12N 2310/14* (2013.01)

(58) Field of Classification Search
USPC ...................... 435/6.1, 91.1, 91.31, 455, 375; 536/23.1, 24.5; 514/44
See application file for complete search history.

(56) References Cited

U.S. PATENT DOCUMENTS

| | | |
|---|---|---|
| 7,217,572 B2 * | 5/2007 | Ward et al. ..................... 435/458 |
| 7,795,422 B2 * | 9/2010 | McSwiggen et al. ........ 536/24.5 |
| 2004/0101858 A1 | 5/2004 | Ward et al. ........................ 435/6 |
| 2009/0191263 A1 | 7/2009 | Reich et al. ................... 424/450 |
| 2010/0105134 A1* | 4/2010 | Quay et al. ..................... 435/366 |
| 2010/0144844 A1 | 6/2010 | Chatterton et al. ......... 514/44 A |

OTHER PUBLICATIONS

Bartholomeusz, et al. "In Vivo Therapeutic Silencing of Hypoxia-Inducible Factor 1 Alpha (HIF-1α) Using Single-Walled Carbon Nanotubes Noncovalently Coated with siRNA," *Nano Res.* vol. 2(4): pp. 279-291, Apr. 17, 2009.
International Bureau of WIPO, International Preliminary Report on Patentability, Written Opinion of the International Search Authority; PCT/US2012/022045; 12 pages, Jul. 23, 2013.
USPTO, International Search Report; PCT/US12/22045; 6 pages, Jul. 17, 2012.

* cited by examiner

*Primary Examiner* — Jane Zara
(74) *Attorney, Agent, or Firm* — Mintz Levin Cohn Ferris Glovsky and Popeo, P.C.; Christopher R. Cowles

(57) ABSTRACT

This invention relates to compounds, compositions, and methods useful for reducing HIF-1α target RNA and protein levels via use of dsRNAs, e.g., Dicer substrate siRNA (DsiRNA) agents.

26 Claims, 47 Drawing Sheets

Human Hif-1α Knockdown – Human (HeLa) Cells – Phase 2
Normalized to HPRT and SFRS9; vs NC1, NC5, NC7

Mouse Hif-1α Knockdown - Mouse (Hepa1-6) Cells – Phase 2
Normalized to HPRT and Rpl23; vs NC1, NC5, NC7

HIF-1α Knockdown – Human (HeLa) Cells – Phase 4, Guide-Passenger Modified Duplexes
Normalized to HPRT and SFRS9; vs NC1, NC5, NC7

HIF-1α Knockdown - Human (HeLa) Cells – Phase 4, Guide-Passenger Modified Duplexes
Normalized to HPRT and SFRS9; vs NC1, NC5, NC7

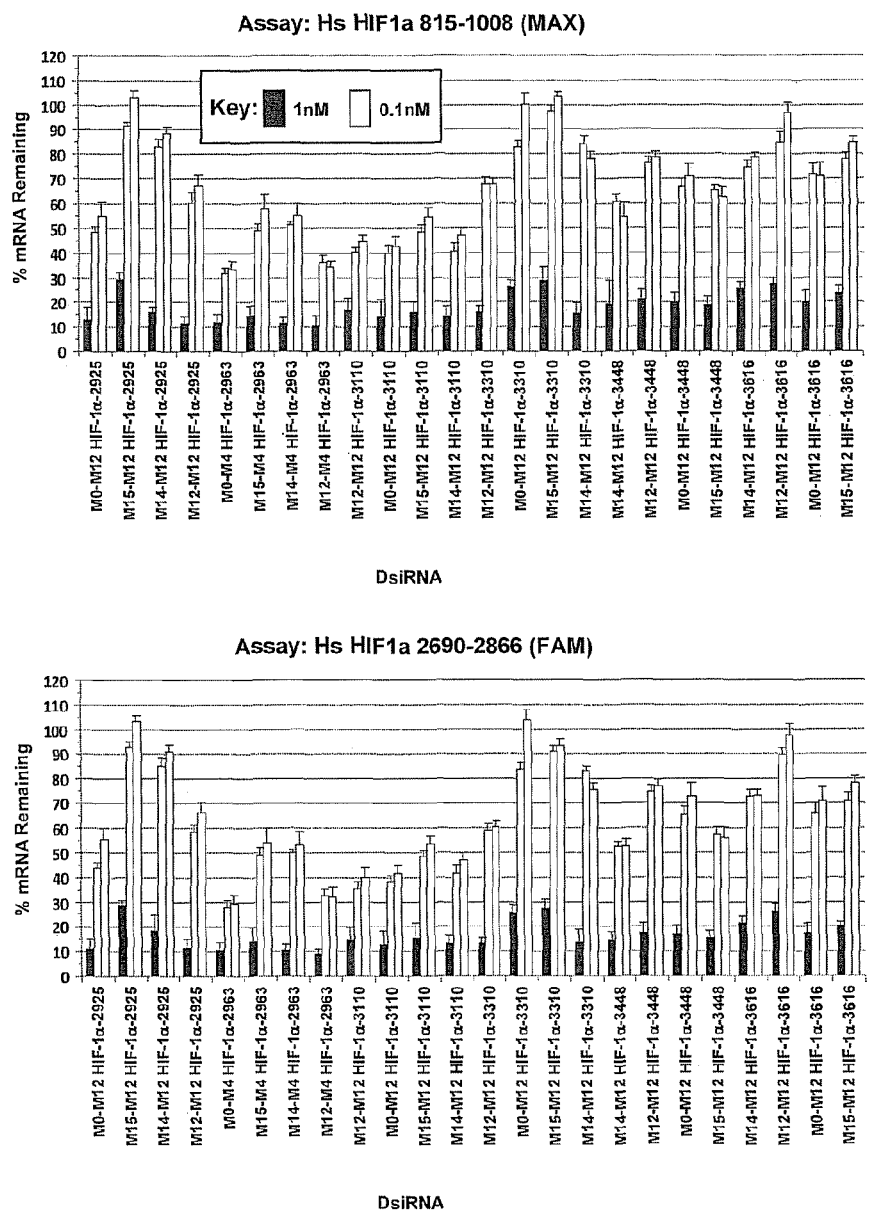

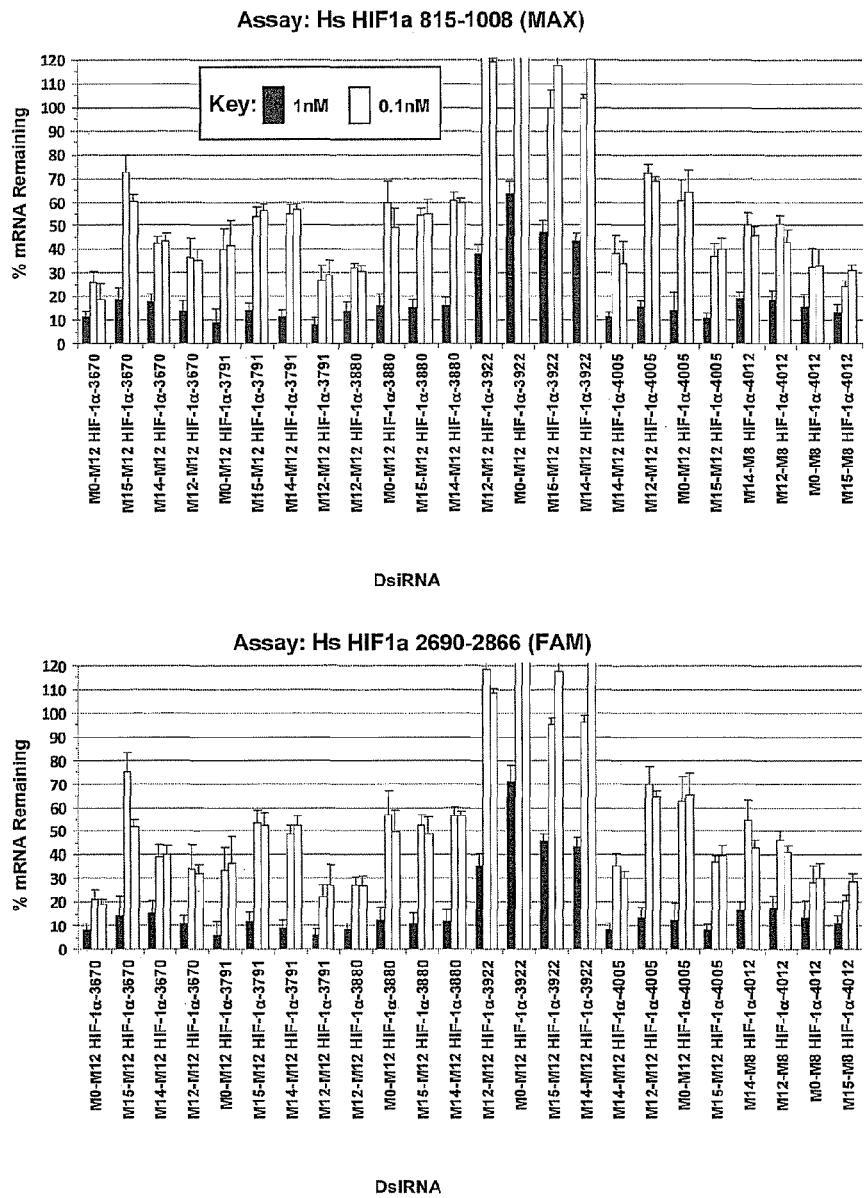

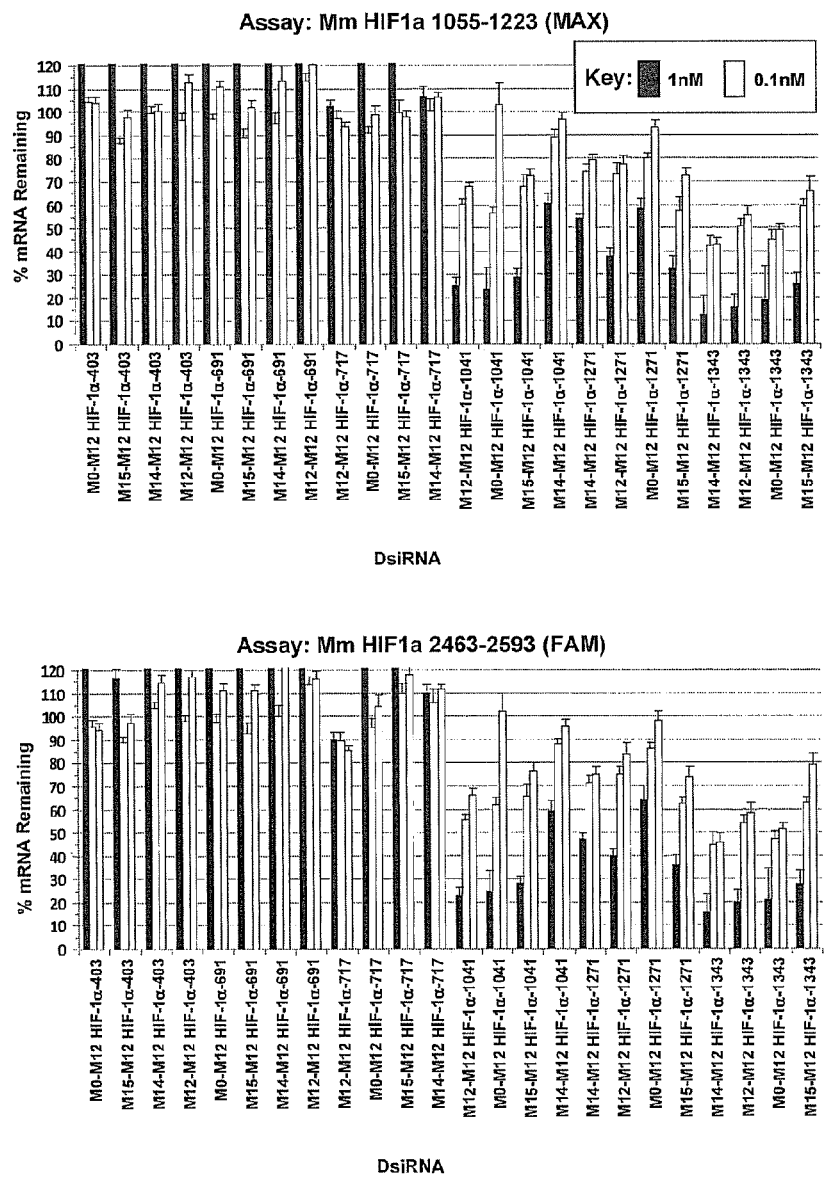

HIF-1α Knockdown - Mouse (Hepa 1-6) Cells – Phase 4, Guide-Passenger Modified Duplexes
Normalized to HPRT and RPL23; vs NC1, NC5, NC7

HIF-1α Knockdown - Mouse (Hepa 1-6) Cells – Phase 4, Guide-Passenger Modified Duplexes
Normalized to HPRT and RPL23; vs NC1, NC5, NC7

HIF-1α Knockdown - Mouse (Hepa 1-6) Cells – Phase 4, Guide-Passenger Modified Duplexes
Normalized to HPRT and RPL23; vs NC1, NC5, NC7

METHODS AND COMPOSITIONS FOR THE SPECIFIC INHIBITION OF HIF-1α BY DOUBLE-STRANDED RNA

CROSS-REFERENCE TO RELATED APPLICATIONS

The application is a continuation application of PCT/US2012/022045, filed Jan. 20, 2012, which claims priority to, and the benefit under 35 U.S.C. §119(e) of, U.S. provisional patent application No. 61/435,304, filed Jan. 22, 2011, entitled "Methods and Compositions for the Specific Inhibition of HIF-1α by Double-Stranded RNA". The entire teachings of this application are incorporated herein by reference.

FIELD OF THE INVENTION

The present invention relates to compounds, compositions, and methods for the study, diagnosis, and treatment of traits, diseases and conditions that respond to the modulation of HIF-1α gene expression and/or activity.

BACKGROUND OF THE INVENTION

Most locally advanced solid tumors contain regions of reduced oxygen availability (Vaupel and Mayer, *Cancer Metastasis Rev.* 26: 225-339; Semenza G L, *Drug Discovery Today* 12: 853-859). Intratumoral hypoxia results when cells are located too far from a functional blood vessel for diffusion of adequate amounts of oxygen ($O_2$), as a result of rapid cancer cell proliferation and the formation of blood vessels that are structurally and functionally abnormal. In the most extreme case, $O_2$ concentrations are below those required for survival, resulting in cell death and establishing a selection for cancer cells in which apoptotic pathways are inactivated, anti-apoptotic pathways are activated, or invasion/metastasis pathways that promote escape from the hypoxic microenvironment are activated. This hypoxic adaptation may arise by alterations in gene expression or by mutations in the genome or both and is associated with decreased patient survival (Ibid.).

In addition to this intratumoral role for hypoxia, systemic, local, and intracellular homeostatic responses elicited by hypoxia include erythropoiesis by individuals who are anemic or at high altitude (Jelkmann (1992) *Physiol. Rev.* 72:449-489), neovascularization in ischemic myocardium (White et al. (1992) *Circ. Res.* 71:1490-1500), and glycolysis in cells cultured at reduced oxygen tension (Wolfle et al. (1983) *Eur. J. Biochem.* 135:405-412). These adaptive responses either increase oxygen delivery or activate alternate metabolic pathways that do not require oxygen. Hypoxia-inducible gene products that participate in these responses include erythropoietin (EPO) (reviewed in Semenza (1994) *Hematol. Oncol. Clinics N. Amer.* 8:863-884), vascular endothelial growth factor (Shweiki et al. (1992) *Nature* 359: 843-845; Banai et al. (1994) *Cardiovasc. Res.* 28:1176-1179; Goldberg & Schneider (1994) *J. Biol. Chem.* 269:4355-4359), and glycolytic enzymes (Firth et al. (1994) *Proc. Natl. Acad. Sci. USA* 91:6496-6500; Semenza et al. (1994) *J. Biol. Chem.* 269: 23757-23763; Semenza U.S. Pat. No. 5,882,914).

Investigation of the molecular regulation of hypoxia and the EPO gene, which encodes a growth factor that regulates erythropoiesis and thus blood oxygen carrying capacity (Jelkmann (1992) supra; Semenza (1994) supra), resulted in identification of cis-acting DNA sequences in the EPO 3'-flanking region required for transcriptional activation in response to hypoxia. HIF-1 (hypoxia inducible factor 1) was identified as a trans-acting factor that binds to this enhancer. Previously known inducers of EPO expression (1% oxygen, cobalt chloride ($CoCl_2$) and desferrioxamine (DFX or, alternatively, DFO herein)) also induced HIF-1 DNA binding activity with similar kinetics; inhibitors of EPO expression (actinomycin D, cycloheximide, and 2-aminopurine) blocked induction of HIF-1 activity; and mutations in the EPO 3'-flanking region that eliminated HIF-1 binding also eliminated enhancer function (Semenza (1994) supra).

HIF-1 is a dimer composed of HIF-1α and HIF-1β subunits. HIF-1α is a basic helix-loop-helix (bHLH) transcription factor encoded by the HIF1A gene (Semenza et al., *Genomics* 34: 437-9; Hogenesch et al., *J. Biol. Chem.* 272: 8581-93). While the HIF-1β subunit is constitutively expressed, the HIF-1α subunit is the limiting member of the heterodimer and therefore regulates HIF-1 levels. Under conditions of normal oxygen, HIF-1α is ubiquinated and rapidly degraded. However, under hypoxic conditions the rate of ubiquitination dramatically decreases and HIF-1α is stabilized, resulting in upregulation of HIF-1 dimer. This is an important point and provides a rationale for targeting HIF-1α instead of HIF-1β for modulating HIF-1 activity (Akinc et al., U.S. Pat. No. 7,737,265).

Notably, HIF-1α overexpression has been associated with increased patient mortality in a variety of cancers (Semenza G L, *Drug Discovery Today* 12: 853-859), and a role for HIF-1α has also been described, e.g., for both "wet" and "dry" forms of age-related macular degeneration (AMD; see Akinc et al., supra).

Double-stranded RNA (dsRNA) agents possessing strand lengths of 25 to 35 nucleotides have been described as effective inhibitors of target gene expression in mammalian cells (Rossi et al., U.S. Patent Application Nos. 2005/0244858 and US 2005/0277610). dsRNA agents of such length are believed to be processed by the Dicer enzyme of the RNA interference (RNAi) pathway, leading such agents to be termed "Dicer substrate siRNA" ("DsiRNA") agents. Additional modified structures of DsiRNA agents were previously described (Rossi et al., U.S. Patent Application No. 2007/0265220).

BRIEF SUMMARY OF THE INVENTION

The present invention is directed to compositions that contain double stranded RNA ("dsRNA"), and methods for preparing them. The dsRNAs of the invention are capable of reducing the expression of a target HIF-1α gene in a cell, either in vitro or in a mammalian subject.

In one aspect, the invention provides an isolated double stranded nucleic acid (dsNA) having first and second nucleic acid strands including RNA, where the first strand is 15-35 nucleotides in length and the second strand of the dsNA is 19-35 nucleotides in length, and where the second oligonucleotide strand is sufficiently complementary to a target HIF-1α mRNA sequence of Table 12 along at least 15 nucleotides of the second oligonucleotide strand length to reduce HIF-1α target mRNA expression when the double stranded nucleic acid is introduced into a mammalian cell.

In another aspect, the invention provides an isolated dsNA having first and second nucleic acid strands, where the first strand is 15-35 nucleotides in length and the second strand of the dsNA is 19-35 nucleotides in length, where the second oligonucleotide strand is sufficiently complementary to a target HIF-1α mRNA sequence of Table 11 along at least 19 nucleotides of the second oligonucleotide strand length to reduce HIF-1α target mRNA expression when the double stranded nucleic acid is introduced into a mammalian cell.

In an additional aspect, the invention provides an isolated dsNA having first and second nucleic acid strands, where the first strand is 15-35 nucleotides in length and the second strand of the dsNA is 19-35 nucleotides in length, where the second oligonucleotide strand is sufficiently complementary to a target HIF-1α mRNA sequence of Table 10 along at least 19 nucleotides of the second oligonucleotide strand length to reduce HIF-1α target mRNA expression, and where, starting from the 5' end of the HIF-1α mRNA sequence of Table 10 (position 1), mammalian Ago2 cleaves the mRNA at a site between positions 9 and 10 of the sequence, when the double stranded nucleic acid is introduced into a mammalian cell.

In a further aspect, the invention provides an isolated dsNA consisting of (1) a sense region and an antisense region, where the sense region and the antisense region together form a duplex region of 25-35 base pairs and the antisense region has a sequence that is the complement of a sequence of Table 10; and (2) from zero to two 3' overhang regions, where each overhang region is six or fewer nucleotides in length.

In another aspect, the invention provides an isolated dsNA having first and second nucleic acid strands and a duplex region of at least 25 base pairs, where the first strand is 25-34 nucleotides in length and the second strand of the dsNA is 26-35 nucleotides in length and has 1-5 single-stranded nucleotides at its 3' terminus, where the second oligonucleotide strand is sufficiently complementary to a target HIF-1α mRNA sequence of Table 5 along at least 19 nucleotides of the second oligonucleotide strand length to reduce HIF-1α target gene expression when the double stranded nucleic acid is introduced into a mammalian cell.

In an additional aspect, the invention provides an isolated dsNA having first and second nucleic acid strands and a duplex region of at least 25 base pairs, where the first strand is 25-34 nucleotides in length and the second strand of the dsNA is 26-35 nucleotides in length and includes 1-5 single-stranded nucleotides at its 3' terminus, where the 3' terminus of the first oligonucleotide strand and the 5' terminus of the second oligonucleotide strand form a blunt end, and the second oligonucleotide strand is sufficiently complementary to a target HIF-1α sequence of SEQ ID NOs: 757-1134, 1630-2007 or 3144-4191 along at least 19 nucleotides of the second oligonucleotide strand length to reduce HIF-1α mRNA expression when the double stranded nucleic acid is introduced into a mammalian cell.

In one embodiment, the isolated dsNA has a duplex region of at least 25 base pairs.

In another embodiment, the isolated dsNA has a duplex region of 19-21 base pairs.

In another embodiment, the isolated dsNA has a duplex region of 21-25 base pairs.

In another embodiment, the second oligonucleotide strand presents 1-5 single-stranded nucleotides at its 3' terminus.

In one embodiment, the first strand is 25-35 nucleotides in length. Optionally, the second strand is 25-35 nucleotides in length.

The invention also provides for an isolated dsNA wherein the first strand is 26-35 nucleotides in length, 27-35 nucleotides in length, 28-35 nucleotides in length, 29-35 nucleotides in length, 30-35 nucleotides in length, 31-35 nucleotides in length, 33-35 nucleotides in length, 34-35 nucleotides in length, 17-35 nucleotides in length, 19-35 nucleotides in length, 21-35 nucleotides in length, 23-35 nucleotides in length, 17-33 nucleotides in length, 17-31 nucleotides in length, 17-29 nucleotides in length, 17-27 nucleotides in length, 21-35 nucleotides in length or 19-33 nucleotides in length.

The invention also provides for an isolated dsNA wherein the second strand is 26-35 nucleotides in length, 27-35 nucleotides in length, 28-35 nucleotides in length, 29-35 nucleotides in length, 30-35 nucleotides in length, 31-35 nucleotides in length, 33-35 nucleotides in length, 34-35 nucleotides in length, 21-35 nucleotides in length, 23-35 nucleotides in length, 25-35 nucleotides in length, 27-35 nucleotides in length, 19-33 nucleotides in length, 19-31 nucleotides in length, 19-29 nucleotides in length, 19-27 nucleotides in length or 19-25 nucleotides in length.

In another embodiment, the second oligonucleotide strand is complementary to a target HIF-1α cDNA sequence of GenBank Accession Nos. NM_001530.3 or NM_181054.2 along at most 27 nucleotides of the second oligonucleotide strand length.

In a further embodiment, starting from the first nucleotide (position 1) at the 3' terminus of the first oligonucleotide strand of the dsNA, position 1, 2 and/or 3 is substituted with a modified nucleotide.

In another embodiment, the 3' terminus of the first strand and the 5' terminus of the second strand form a blunt end.

Optionally, the first strand is 25 nucleotides in length and the second strand is 27 nucleotides in length.

In another embodiment, starting from the 5' end of a HIF-1α mRNA sequence of Table 10 (position 1), mammalian Ago2 cleaves the HIF-1α mRNA at a site between positions 9 and 10 of the sequence, thereby reducing HIF-1α target mRNA expression when the double stranded nucleic acid is introduced into a mammalian cell.

In a related embodiment, starting from the 5' end of a HIF-1α mRNA sequence of SEQ ID NOs: 757-1134, mammalian Ago2 cleaves the mRNA at a site between positions 9 and 10 of the cDNA sequence, thereby reducing HIF-1α target mRNA expression when the double stranded nucleic acid is introduced into a mammalian cell.

In another embodiment, the second strand includes a sequence of SEQ ID NOs: 379-756. Optionally, the first strand includes a sequence of SEQ ID NOs: 1-378.

In a further embodiment, the isolated dsNA includes a pair of first strand/second strand sequences shown in Table 2.

In one embodiment, each of the first and the second strands is at least 26 nucleotides long.

The invention also provides for an isolated dsNA, wherein each of said first and said second strands has a length which is at least 27 nucleotides, at least 28 nucleotides, at least 29 nucleotides, at least 30 nucleotides, at least 31 nucleotides, at least 32 nucleotides, at least 33 nucleotides, at least 34 nucleotides or at least 35 nucleotides.

In one embodiment, the dsNA includes a modified nucleotide. Optionally, the modified nucleotide residue is 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)$_2$-O-2'-bridge, 2'-LNA, 2'-amino or 2'-O—(N-methlycarbamate)

In another embodiment, the modified nucleotide residue of the 3' terminus of the first strand is a deoxyribonucleotide, an acyclonucleotide or a fluorescent molecule. Optionally, position 1 of the 3' terminus of the first oligonucleotide strand is a deoxyribonucleotide.

In another embodiment, the nucleotides of the 1-5 single-stranded nucleotides of the 3' terminus of the second strand include a modified nucleotide. Optionally, the modified nucleotide is a 2'-O-methyl ribonucleotide.

In one embodiment, all nucleotides of the 1-5 single-stranded nucleotides of the 3' terminus of the second strand are modified nucleotides.

In another embodiment, the 1-5 single-stranded nucleotides of the 3' terminus of the second strand are 1-3 nucleotides in length, optionally, 1-2 nucleotides in length.

In one embodiment, the 1-5 single-stranded nucleotides of the 3' terminus of the second strand is two nucleotides in length and includes a 2'-O-methyl modified ribonucleotide.

Optionally, the second oligonucleotide strand includes a modification pattern of AS-M1 to AS-M40 or AS-M1* to AS-M40*. In a related embodiment, the first oligonucleotide strand includes a modification pattern of SM1 to SM16.

In one embodiment, each of the first and the second strands has a length which is at least 26 and at most 30 nucleotides.

The invention also provides for an isolated dsNA, wherein each of the first and the second strands has a length which is at least 27 and at most 30 nucleotides, at least 28 and at most 30 nucleotides and at least 29 and at most 30 nucleotides.

In another embodiment, the dsNA is cleaved endogenously in a cell by Dicer.

In a further embodiment, the amount of the isolated double stranded nucleic acid sufficient to reduce expression of the target gene is 1 nanomolar or less, 200 picomolar or less, 100 picomolar or less, 50 picomolar or less, 20 picomolar or less, 10 picomolar or less, 5 picomolar or less, 2, picomolar or less or 1 picomolar or less in the environment of the cell.

In another embodiment, the isolated dsNA possesses greater potency than an isolated 21mer siRNA directed to the identical at least 19 nucleotides of the target HIF-1α mRNA in reducing target HIF-1α mRNA expression when assayed in vitro in a mammalian cell at an effective concentration in the environment of the cell of 1 nanomolar or less.

In a further embodiment, the isolated dsNA is sufficiently complementary to the target HIF-1α mRNA sequence to reduce HIF-1α target mRNA expression by an amount (expressed by %) of at least 10%, at least 50%, at least 80-90%, at least 95%, at least 98%, or at least 99% when the double stranded nucleic acid is introduced into a mammalian cell.

The invention provides for an isolated dsNA that is sufficiently complementary to a target HIF-1α mRNA sequence along at least 15, 16, 17, 18, 19, 20, 21, 22, 23, 24, 25 or more nucleotides of the second oligonucleotide strand length to reduce HIF-1α target mRNA expression when the dsNA is introduced into a mammalian cell.

In one embodiment, the first and second strands are joined by a chemical linker.

In another embodiment, the 3' terminus of the first strand and the 5' terminus of the second strand are joined by a chemical linker.

Optionally, a nucleotide of the second or first strand is substituted with a modified nucleotide that directs the orientation of Dicer cleavage.

In one embodiment, the dsNA has a modified nucleotide that is a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, or a locked nucleic acid.

In another embodiment, the dsNA has a phosphate backbone modification that is a phosphonate, a phosphorothioate or a phosphotriester.

In a further embodiment, the isolated double stranded nucleic acid includes a morpholino nucleic acid or a peptide nucleic acid (PNA).

Another aspect of the invention provides a method for reducing expression of a target HIF-1α gene in a mammalian cell that involves contacting a mammalian cell in vitro with an isolated dsNA of the invention in an amount sufficient to reduce expression of a target HIF-1α mRNA in the cell.

In one embodiment, target HIF-1α mRNA expression is reduced by at least 10%, at least 50% or at least 80-90%. Optionally, HIF-1α mRNA levels are reduced by at least 90% at least 8 days after the cell is contacted with the dsNA. In certain embodiments, HIF-1α mRNA levels are reduced by at least 70% at least 10 days after the cell is contacted with the dsNA.

In another aspect, the invention provides a method for reducing expression of a target HIF-1α mRNA in a mammal that includes administering an isolated dsNA of the invention to a mammal in an amount sufficient to reduce expression of a target HIF-1α mRNA in the mammal.

In one embodiment, the isolated dsNA is administered at 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In another embodiment, the isolated dsNA possesses greater potency than isolated 21mer siRNAs directed to the identical at least 19 nucleotides of the target HIF-1α mRNA in reducing target HIF-1α mRNA expression when assayed in vitro in a mammalian cell at an effective concentration in the environment of a cell of 1 nanomolar or less.

In one embodiment, HIF-1α mRNA levels are reduced in a tissue of the mammal by an amount (expressed by %) of at least 70% at least 4 days after the isolated dsNA is administered to the mammal. In a related embodiment, the tissue is liver tissue.

Optionally, the administering step involves intravenous injection, intramuscular injection, intraperitoneal injection, infusion, subcutaneous injection, transdermal, aerosol, rectal, vaginal, topical, oral or inhaled delivery.

Another aspect of the invention provides a method for selectively inhibiting the growth of a cell involving contacting a cell with an amount of an isolated dsNA of the invention sufficient to inhibit the growth of the cell.

In one embodiment, the cell is a tumor cell of a subject. In another embodiment, the cell is a tumor cell in vitro.

Optionally, the cell is a human cell.

A further aspect of the invention provides a formulation that includes the isolated dsNA of the invention present in an amount effective to reduce target HIF-1α mRNA levels when the dsNA is introduced into a mammalian cell in vitro by at least 10%, at least 50% or at least 80-90%.

In one embodiment, the effective amount is 1 nanomolar or less, 200 picomolar or less, 100 picomolar or less, 50 picomolar or less, 20 picomolar or less, 10 picomolar or less, 5 picomolar or less, 2, picomolar or less or 1 picomolar or less in the environment of the cell.

Another aspect of the invention provides a formulation having an isolated dsNA of the invention, where the dsNA is present in an amount effective to reduce target HIF-1α mRNA levels when the dsNA is introduced into a cell of a mammalian subject by an amount (expressed by %) of at least 10%, at least 50% or at least 80-90%.

In one embodiment, the effective amount is a dosage of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In another embodiment, the dsNA possesses greater potency than an isolated 21mer siRNA directed to the identical at least 19 nucleotides of the target HIF-1α mRNA in reducing target HIF-1α mRNA levels when assayed in vitro in a mammalian cell at an effective concentration in the environment of a cell of 1 nanomolar or less.

A further aspect of the invention provides a mammalian cell containing an isolated dsNA of the invention.

An additional aspect of the invention provides a pharmaceutical composition having an isolated dsNA of the invention and a pharmaceutically acceptable carrier.

Another aspect of the invention provides a kit that includes an isolated dsNA of the invention and instructions for its use.

In an additional aspect, the invention provides a method for treating or preventing a HIF-1α-associated disease or disorder in a subject involving administering an isolated dsNA of the invention and a pharmaceutically acceptable carrier to the subject in an amount sufficient to treat or prevent the HIF-1α-associated disease or disorder in the subject, thereby treating or preventing the HIF-1α-associated disease or disorder in the subject.

Optionally, the HIF-1α-associated disease or disorder is renal, breast, lung, ovarian, cervical, esophageal, oropharyngeal or pancreatic cancer.

A further aspect of the invention provides a composition possessing HIF-1α inhibitory activity that consists essentially of an isolated dsNA of the invention.

In one aspect, the invention provides an isolated double stranded ribonucleic acid (dsRNA) comprising first and second nucleic acid strands, wherein the first strand is 25-35 nucleotides in length and the second strand is 26-35 nucleotides in length, wherein the second oligonucleotide strand is sufficiently complementary to a target HIF-1α cDNA sequence of SEQ ID NOs: 757-1134, 1630-2007 and/or 3144-4191 along at least 19 nucleotides of the second oligonucleotide strand length to reduce HIF-1α target gene expression when the double stranded nucleic acid is introduced into a mammalian cell.

The present invention is also directed to compounds, compositions, and methods relating to traits, diseases and conditions that respond to the modulation of expression and/or activity of genes involved in HIF-1α gene expression pathways or other cellular processes that mediate the maintenance or development of such traits, diseases and conditions. In certain aspects, the invention relates to small nucleic acid molecules that are capable of being processed by the Dicer enzyme, such as Dicer substrate siRNAs (DsiRNAs) capable of mediating RNA interference (RNAi) against HIF-1α gene expression. The anti-HIF-1α dsRNAs of the invention are useful, for example, in providing compositions for treatment of traits, diseases and conditions that can respond to modulation of HIF-1α in a subject, such as cancer and/or other proliferative diseases, disorders, or conditions. Efficacy, potency, toxicity and other effects of an anti-HIF-1α dsRNA can be examined in one or more animal models of proliferative disease (exemplary animal models of proliferative disease are recited below).

BRIEF DESCRIPTION OF THE DRAWINGS

FIGS. 3A to 3C) or mouse cells (Hepa1-6 cell assays; FIGS. 3D to 3F). In phase 2, DsiRNAs were tested at 1 nM, at 0.3 nM and at 0.1 nM in the environment of HeLa cells. Individual bars represent average human (FIGS. 3A to 3C) or mouse (FIGS. 3D to 3F) HIF-1α levels observed in triplicate, with standard errors shown. Human HIF-1α levels were normalized to HPRT and SFRS9 levels, while mouse HIF-1α levels were normalized to HPRT and Rpl23 levels.

FIGS. 8A to 8H show HIF-1α inhibitory activities of HIF-1α-targeting DsiRNAs possessing 2'-O-methyl modification patterns of both guide and passenger strands, when administered to human HeLa cells (FIGS. 8A to 8D) or mouse Hepa 1-6 cells (FIGS. 8E to 8H) at 1 nM or 0.1 nM concentrations.

Figure 9:
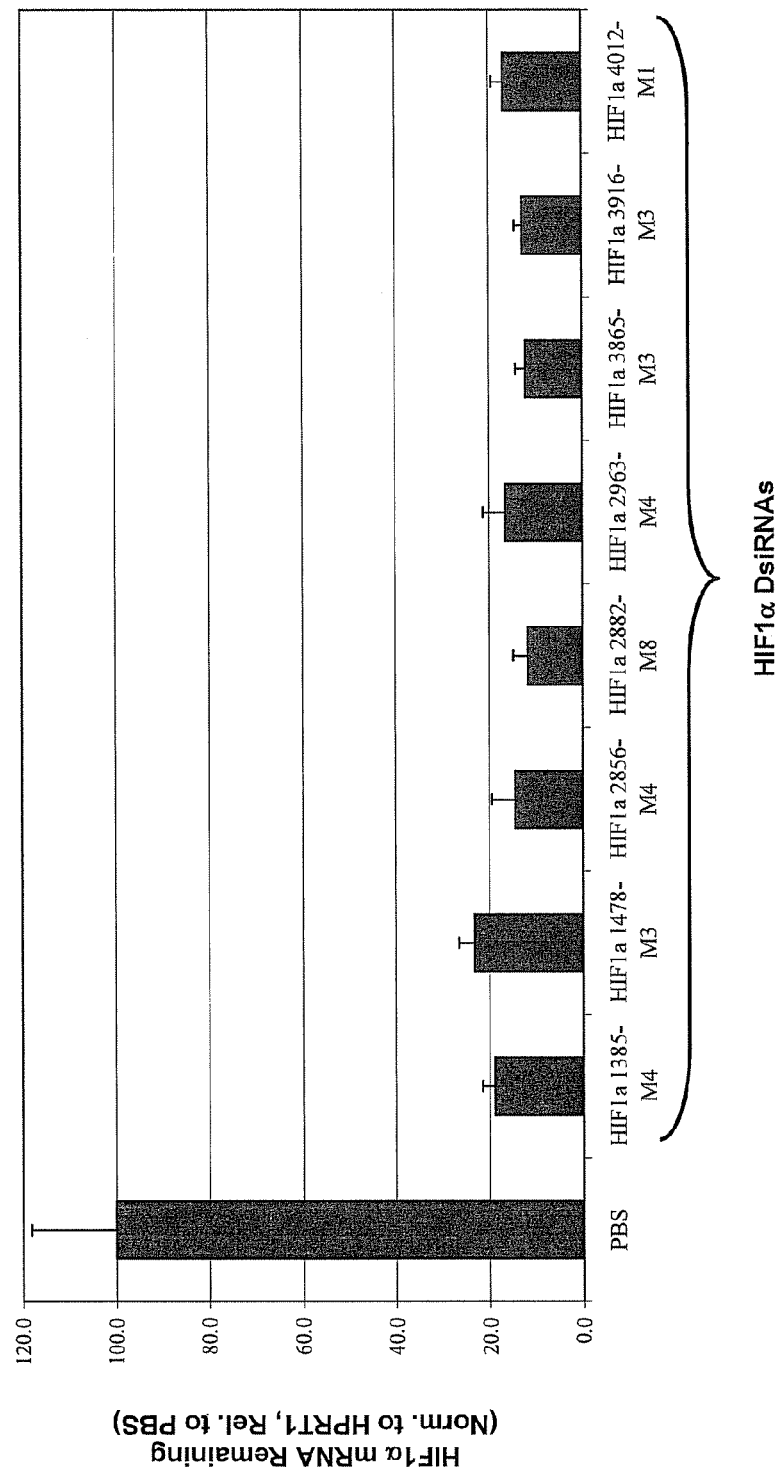

FIG. 9 shows that eight distinct HIF-1α-targeting DsiRNAs possessing modified guide strands were robustly effective inhibitors of HIF-1α levels in vivo, when formulated and delivered to CD1 mice. Levels of HIF-1α mRNA in normal liver at three days post-administration were assayed and are shown.

DETAILED DESCRIPTION OF THE INVENTION

The present invention is directed to compositions that contain double stranded RNA ("dsRNA"), and methods for preparing them, that are capable of reducing the level and/or expression of the HIF-1α gene in vivo or in vitro. One of the strands of the dsRNA contains a region of nucleotide sequence that has a length that ranges from 19 to 35 nucleotides that can direct the destruction and/or translational inhibition of the targeted HIF-1α transcript.

DEFINITIONS

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

The present invention features one or more DsiRNA molecules that can modulate (e.g., inhibit) HIF-1α expression. The DsiRNAs of the invention optionally can be used in combination with modulators of other genes and/or gene products associated with the maintenance or development of diseases or disorders associated with HIF-1α misregulation (e.g., tumor formation and/or growth, etc.). The DsiRNA agents of the invention modulate HIF-1α RNAs such as those corresponding to the cDNA sequences referred to by GenBank Accession Nos. NM_001530.3 (human HIF-1α, transcript variant 1), NM_181054.2 (human HIF-1α, transcript variant 2) and NM_010431.2 (mouse HIF-1α), which are recited below and referred to herein generally as "HIF-1α."

The below description of the various aspects and embodiments of the invention is provided with reference to exemplary HIF-1α RNAs, generally referred to herein as HIF-1α. However, such reference is meant to be exemplary only and the various aspects and embodiments of the invention are also directed to alternate HIF-1α RNAs, such as mutant HIF-1α RNAs or additional HIF-1α splice variants. Certain aspects and embodiments are also directed to other genes involved in HIF-1α pathways, including genes whose misregulation acts in association with that of HIF-1α (or is affected or affects HIF-1α regulation) to produce phenotypic effects that may be targeted for treatment (e.g., tumor formation and/or growth, etc.). (The EGFR pathway and angiogenesis are examples of pathways for which misregulation of genes acts in association with that of HIF-1α). Such additional genes can be targeted using dsRNA and the methods described herein for use of HIF-1α targeting dsRNAs. Thus, the inhibition and the effects of such inhibition of the other genes can be performed as described herein.

The term "HIF-1α" refers to nucleic acid sequences encoding a HIF-1α protein, peptide, or polypeptide (e.g., HIF-1α transcripts, such as the sequences of HIF-1α Genbank Accession Nos. NM_001530.3, NM_181054.2 and NM_010431.2). In certain embodiments, the term "HIF-1α" is also meant to include other HIF-1α encoding sequence, such as other HIF-1α isoforms, mutant HIF-1α genes, splice variants of HIF-1α genes, and HIF-1α gene polymorphisms. The term "HIF-1α" is also used to refer to the polypeptide gene product of a HIF-1α gene/transript, e.g., a HIF-1α protein, peptide, or polypeptide, such as those encoded by HIF-1α Genbank Accession Nos. NM_001530.3, NM_181054.2 and NM_010431.2.

As used herein, a "HIF-1α-associated disease or disorder" refers to a disease or disorder known in the art to be associated with altered HIF-1α expression, level and/or activity. Notably, a "HIF-1α-associated disease or disorder" includes cancer and/or proliferative diseases, conditions, or disorders, as well as age-related macular degeneration (AMD). Exemplary "HIF-1α-associated disease or disorders" include bladder, brain, breast, cervical (uterine), colorectal, endometrial (uterine), esophageal, head and neck, liver, lung (NSCLC), oropharyngeal, ovarian, pancreatic, renal, skin (melanoma) and stomach (GIST) cancers.

By "proliferative disease" or "cancer" as used herein is meant, a disease, condition, trait, genotype or phenotype characterized by unregulated cell growth or replication as is known in the art; including leukemias, for example, acute myelogenous leukemia (AML), chronic myelogenous leukemia (CML), acute lymphocytic leukemia (ALL), and chronic lymphocytic leukemia, AIDS related cancers such as Kaposi's sarcoma; breast cancers; bone cancers such as Osteosarcoma, Chondrosarcomas, Ewing's sarcoma, Fibrosarcomas, Giant cell tumors, Adamantinomas, and Chordomas; Brain cancers such as Meningiomas, Glioblastomas, Lower-Grade Astrocytomas, Oligodendrocytomas, Pituitary Tumors, Schwannomas, and Metastatic brain cancers; cancers of the head and neck including various lymphomas such as mantle cell lymphoma, non-Hodgkins lymphoma, adenoma, squamous cell carcinoma, laryngeal carcinoma, gallbladder and bile duct cancers, cancers of the retina such as retinoblastoma, cancers of the esophagus, gastric cancers, multiple myeloma, ovarian cancer, uterine cancer, thyroid cancer, testicular cancer, endometrial cancer, melanoma, colorectal cancer, lung cancer, bladder cancer, prostate cancer, lung cancer (including non-small cell lung carcinoma), pancreatic cancer, sarcomas, Wilms' tumor, cervical cancer, head and neck cancer, skin cancers, nasopharyngeal carcinoma, liposarcoma, epithelial carcinoma, renal cell carcinoma, gallbladder adeno carcinoma, parotid adenocarcinoma, endometrial sarcoma, multidrug resistant cancers; and proliferative diseases and conditions, such as neovascularization associated with tumor angiogenesis, macular degeneration (e.g., wet/dry AMD), corneal neovascularization, diabetic retinopathy, neovascular glaucoma, myopic degeneration and other proliferative diseases and conditions such as restenosis and polycystic kidney disease, and other cancer or proliferative disease, condition, trait, genotype or phenotype that can respond to the modulation of disease related gene expression in a cell or tissue, alone or in combination with other therapies.

In certain embodiments, dsRNA-mediated inhibition of a HIF-1α target sequence is assessed. In such embodiments, HIF-1α RNA levels can be assessed by art-recognized methods (e.g., RT-PCR, Northern blot, expression array, etc.), optionally via comparison of HIF-1α levels in the presence of an anti-HIF-1α dsRNA of the invention relative to the absence of such an anti-HIF-1α dsRNA. In certain embodiments, HIF-1α levels in the presence of an anti-HIF-1α dsRNA are compared to those observed in the presence of vehicle alone, in the presence of a dsRNA directed against an unrelated target RNA, or in the absence of any treatment.

It is also recognized that levels of HIF-1α protein can be assessed and that HIF-1α protein levels are, under different conditions, either directly or indirectly related to HIF-1α RNA levels and/or the extent to which a dsRNA inhibits HIF-1α expression, thus art-recognized methods of assessing HIF-1α protein levels (e.g., Western blot, immunoprecipitation, other antibody-based methods, etc.) can also be employed to examine the inhibitory effect of a dsRNA of the invention.

An anti-HIF-1α dsRNA of the invention is deemed to possess "HIF-1α inhibitory activity" if a statistically significant reduction in HIF-1α RNA (or when the HIF-1α protein is assessed, HIF-1α protein levels) is seen when an anti-HIF-1α dsRNA of the invention is administered to a system (e.g., cell-free in vitro system), cell, tissue or organism, as compared to a selected control. The distribution of experimental values and the number of replicate assays performed will tend to dictate the parameters of what levels of reduction in HIF-1α RNA (either as a % or in absolute terms) is deemed statistically significant (as assessed by standard methods of determining statistical significance known in the art). However, in certain embodiments, "HIF-1α inhibitory activity" is defined based upon a % or absolute level of reduction in the level of HIF-1α in a system, cell, tissue or organism. For example, in certain embodiments, a dsRNA of the invention is deemed to possess HIF-1α inhibitory activity if at least a 5% reduction or at least a 10% reduction in HIF-1α RNA is observed in the presence of a dsRNA of the invention relative to HIF-1α levels seen for a suitable control. (For example, in vivo HIF-1α levels in a tissue and/or subject can, in certain embodiments, be deemed to be inhibited by a dsRNA agent of the invention if, e.g., a 5% or 10% reduction in HIF-1α levels is observed relative to a control). In certain other embodiments, a dsRNA of the invention is deemed to possess HIF-1α inhibitory activity if HIF-1α RNA levels are observed to be reduced by at least 15% relative to a selected control, by at least 20% relative to a selected control, by at least 25% relative to a selected control, by at least 30% relative to a selected control, by at least 35% relative to a selected control, by at least 40% relative to a selected control, by at least 45% relative to a selected control, by at least 50% relative to a selected control, by at least 55% relative to a selected control, by at least 60% relative to a selected control, by at least 65% relative to a selected control, by at least 70% relative to a selected control, by at least 75% relative to a selected control, by at least 80% relative to a selected control, by at least 85% relative to a selected control, by at least 90% relative to a selected control, by at least 95% relative to a selected control, by at least 96% relative to a selected control, by at least 97% relative to a selected control, by at least 98% relative to a selected control or by at least 99% relative to a selected control. In some embodiments, complete inhibition of HIF-1α is required for a dsRNA to be deemed to possess HIF-1α inhibitory activity. In certain models (e.g., cell culture), a dsRNA is deemed to possess HIF-1α inhibitory activity if at least a 50% reduction in HIF-1α levels is observed relative to a suitable control. In certain other embodiments, a dsRNA is deemed to possess HIF-1α inhibitory activity if at least an 80% reduction in HIF-1α levels is observed relative to a suitable control.

By way of specific example, in Example 2 below, a series of DsiRNAs targeting HIF-1α were tested for the ability to reduce HIF-1α mRNA levels in human HeLa or mouse Hepa 1-6 cells in vitro, at 1 nM concentrations in the environment of such cells and in the presence of a transfection agent (Lipofectamine™ RNAiMAX, Invitrogen). Within Example 2 below, HIF-1α inhibitory activity was ascribed to those DsiRNAs that were observed to effect at least a 70% reduction of HIF-1α mRNA levels under the assayed conditions. It is contemplated that HIF-1α inhibitory activity could also be attributed to a dsRNA under either more or less stringent conditions than those employed for Example 2 below, even when the same or a similar assay and conditions are employed. For example, in certain embodiments, a tested dsRNA of the invention is deemed to possess HIF-1α inhibitory activity if at least a 10% reduction, at least a 20% reduction, at least a 30% reduction, at least a 40% reduction, at least a 50% reduction, at least a 60% reduction, at least a 75% reduction, at least an 80% reduction, at least an 85% reduction, at least a 90% reduction, or at least a 95% reduction in HIF-1α mRNA levels is observed in a mammalian cell line in vitro at 1 nM dsRNA concentration or lower in the environment of a cell, relative to a suitable control.

Use of other endpoints for determination of whether a double stranded RNA of the invention possesses HIF-1α inhibitory activity is also contemplated. Specifically, in one embodiment, in addition to or as an alternative to assessing HIF-1α mRNA levels, the ability of a tested dsRNA to reduce HIF-1α protein levels (e.g., at 48 hours after contacting a mammalian cell in vitro or in vivo) is assessed, and a tested dsRNA is deemed to possess HIF-1α inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in HIF-1α protein levels is observed in a mammalian cell contacted with the assayed double stranded RNA in vitro or in vivo, relative to a suitable control. Additional endpoints contemplated include, e.g., assessment of a phenotype associated with reduction of HIF-1α levels—e.g., reduction of growth of a contacted mammalian cell line in vitro and/or reduction of growth of a tumor in vivo, including, e.g., halting or reducing the growth of tumor or cancer cell levels as described in greater detail elsewhere herein.

HIF-1α inhibitory activity can also be evaluated over time (duration) and over concentration ranges (potency), with assessment of what constitutes a dsRNA possessing HIF-1α inhibitory activity adjusted in accordance with concentrations administered and duration of time following administration. Thus, in certain embodiments, a dsRNA of the invention is deemed to possess HIF-1α inhibitory activity if at least a 50% reduction in HIF-1α activity is observed/persists at a duration of time of 2 hours, 5 hours, 10 hours, 1 day, 2 days, 3 days, 4 days, 5 days, 6 days, 7 days, 8 days, 9 days, 10 days or more after administration of the dsRNA to a cell or organism. In additional embodiments, a dsRNA of the invention is deemed to be a potent HIF-1α inhibitory agent if HIF-1α inhibitory activity (e.g., in certain embodiments, at least 50% inhibition of HIF-1α) is observed at a concentration of 1 nM or less, 500 pM or less, 200 pM or less, 100 pM or less, 50 pM or less, 20 pM or less, 10 pM or less, 5 pM or less, 2 pM or less or even 1 pM or less in the environment of a cell, for example, within an in vitro assay for HIF-1α inihibitory activity as described herein. In certain embodiments, a potent HIF-1α inhibitory dsRNA of the invention is defined as one that is capable of HIF-1α inhibitory activity (e.g., in certain embodiments, at least 20% reduction of HIF-1α levels) at a formulated concentration of 10 mg/kg or less when administered to a subject in an effective delivery vehicle (e.g., an effective lipid nanoparticle formulation). Preferably, a potent HIF-1α inhibitory dsRNA of the invention is defined as one that is capable of HIF-1α inihibitory activity (e.g., in certain embodiments, at least 50% reduction of HIF-1α levels) at a formulated concentration of 5 mg/kg or less when administered to a subject in an effective delivery vehicle. More preferably, a potent HIF-1α inhibitory dsRNA of the invention is defined as one that is capable of HIF-1α inihibitory activity (e.g., in certain embodiments, at least 50% reduction of HIF-1α levels) at a formulated concentration of 5 mg/kg or less when administered to a subject in an effective delivery vehicle. Optionally, a potent HIF-1α inhibitory dsRNA of the invention is defined as one that is capable of HIF-1α inihibitory activity (e.g., in certain embodiments, at least 50% reduction of HIF-1α levels) at a formulated concentration of 2 mg/kg or less, or even 1 mg/kg or less, when administered to a subject in an effective delivery vehicle.

In certain embodiments, potency of a dsRNA of the invention is determined in reference to the number of copies of a dsRNA present in the cytoplasm of a target cell that are required to achieve a certain level of target gene knockdown. For example, in certain embodiments, a potent dsRNA is one capable of causing 50% or greater knockdown of a target mRNA when present in the cytoplasm of a target cell at a copy number of 1000 or fewer RISC-loaded antisense strands per cell. More preferably, a potent dsRNA is one capable of producing 50% or greater knockdown of a target mRNA when present in the cytoplasm of a target cell at a copy number of 500 or fewer RISC-loaded antisense strands per cell. Optionally, a potent dsRNA is one capable of producing 50% or greater knockdown of a target mRNA when present in the cytoplasm of a target cell at a copy number of 300 or fewer RISC-loaded antisense strands per cell.

In further embodiments, the potency of a DsiRNA of the invention can be defined in reference to a 19 to 23mer dsRNA directed to the same target sequence within the same target gene. For example, a DsiRNA of the invention that possesses enhanced potency relative to a corresponding 19 to 23mer dsRNA can be a DsiRNA that reduces a target gene by an additional 5% or more, an additional 10% or more, an additional 20% or more, an additional 30% or more, an additional 40% or more, or an additional 50% or more as compared to a corresponding 19 to 23mer dsRNA, when assayed in an in vitro assay as described herein at a sufficiently low concentration to allow for detection of a potency difference (e.g., transfection concentrations at or below 1 nM in the environment of a cell, at or below 100 pM in the environment of a cell, at or below 10 pM in the environment of a cell, at or below 1 nM in the environment of a cell, in an in vitro assay as described herein; notably, it is recognized that potency differences can be best detected via performance of such assays across a range of concentrations—e.g., 0.1 pM to 10 nM—for purpose of generating a dose-response curve and identifying an IC50 value associated with a DsiRNA/dsRNA).

HIF-1α inhibitory levels and/or HIF-1α levels may also be assessed indirectly, e.g., measurement of a reduction of the size, number and/or rate of growth or spread of polyps or tumors in a subject may be used to assess HIF-1α levels and/or HIF-1α inhibitory efficacy of a double-stranded nucleic acid of the instant invention.

In certain embodiments, the phrase "consists essentially of" is used in reference to the anti-HIF-1α dsRNAs of the invention. In some such embodiments, "consists essentially of" refers to a composition that comprises a dsRNA of the invention which possesses at least a certain level of HIF-1α inhibitory activity (e.g., at least 50% HIF-1α inhibitory activity) and that also comprises one or more additional components and/or modifications that do not significantly impact the HIF-1α inhibitory activity of the dsRNA. For example, in certain embodiments, a composition "consists essentially of" a dsRNA of the invention where modifications of the dsRNA of the invention and/or dsRNA-associated components of the composition do not alter the HIF-1α inhibitory activity (optionally including potency or duration of HIF-1α inhibitory activity) by greater than 3%, greater than 5%, greater than 10%, greater than 15%, greater than 20%, greater than 25%, greater than 30%, greater than 35%, greater than 40%, greater than 45%, or greater than 50% relative to the dsRNA of the invention in isolation. In certain embodiments, a composition is deemed to consist essentially of a dsRNA of the invention even if more dramatic reduction of HIF-1α inhibitory activity (e.g., 80% reduction, 90% reduction, etc. in efficacy, duration and/or potency) occurs in the presence of additional components or modifications, yet where HIF-1α inhibitory activity is not significantly elevated (e.g., observed levels of HIF-1α inhibitory activity are within 10% those observed for the isolated dsRNA of the invention) in the presence of additional components and/or modifications.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs) and unlocked nucleic acids (UNAs; see, e.g., Jensen et al. *Nucleic Acids Symposium Series* 52: 133-4), and derivatives thereof.

As used herein, "nucleotide" is used as recognized in the art to include those with natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, e.g., Usman and McSwiggen, supra; Eckstein, et al., International PCT Publication No. WO 92/07065; Usman et al, International PCT Publication No. WO 93/15187; Uhlman & Peyman, supra, all are hereby incorporated by reference herein). There are several examples of modified nucleic acid bases known in the art as summarized by Limbach, et al, *Nucleic Acids Res.* 22:2183, 1994. Some of the non-limiting examples of base modifications that can be introduced into nucleic acid molecules include, hypoxanthine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine and uracil at 1' position or their equivalents.

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occurring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-methoxyethoxy, 2'-fluoro, 2'-allyl, 2'-O-[2-(methylamino)-2-oxoethyl], 4'-thio, 4'-CH$_2$—O-2'-bridge, 4'-(CH$_2$)$_2$—O-2'-bridge, 2'-LNA or other bicyclic or "bridged" nucleoside analog, and 2'-O—(N-methylcarbamate) or those comprising base analogs. In connection with 2'-modified nucleotides as described for the present disclosure, by "amino" is meant 2'—NH$_2$ or 2'-O—NH$_2$, which can be modified or unmodified. Such modified groups are described, e.g., in Eckstein et al., U.S. Pat. No. 5,672,695 and Matulic-Adamic et al., U.S. Pat. No. 6,248,878. "Modified nucleotides" of the instant invention can also include nucleotide analogs as described above.

In reference to the nucleic acid molecules of the present disclosure, modifications may exist upon these agents in patterns on one or both strands of the double stranded ribonucleic acid (dsRNA). As used herein, "alternating positions" refers to a pattern where every other nucleotide is a modified nucleotide or there is an unmodified nucleotide (e.g., an unmodified ribonucleotide) between every modified nucleotide over a defined length of a strand of the dsRNA (e.g., 5'-MNMNMN-3'; 3'-MNMNMN-5'; where M is a modified nucleotide and N is an unmodified nucleotide). The modification pattern starts from the first nucleotide position at either the 5' or 3' terminus according to a position numbering convention, e.g., as described herein (in certain embodiments, position 1 is designated in reference to the terminal residue of a strand following a projected Dicer cleavage event of a DsiRNA agent of the invention; thus, position 1 does not always constitute a 3' terminal or 5' terminal residue of a pre-processed agent of the invention). The pattern of modified nucleotides at alternating positions may run the full length of the strand, but in certain embodiments includes at least 4, 6, 8, 10, 12, 14 nucleotides containing at least 2, 3, 4, 5, 6 or 7 modified nucleotides, respectively. As used herein, "alternating pairs of positions" refers to a pattern where two consecutive modified nucleotides are separated by two consecutive unmodified nucleotides over a defined length of a strand of the dsRNA (e.g., 5'-MMNNMMNNMMNN-3'; 3'-MMNNMMNNM-MNN-5'; where M is a modified nucleotide and N is an unmodified nucleotide). The modification pattern starts from the first nucleotide position at either the 5' or 3' terminus according to a position numbering convention such as those described herein. The pattern of modified nucleotides at alternating positions may run the full length of the strand, but preferably includes at least 8, 12, 16, 20, 24, 28 nucleotides containing at least 4, 6, 8, 10, 12 or 14 modified nucleotides, respectively. It is emphasized that the above modification patterns are exemplary and are not intended as limitations on the scope of the invention.

As used herein, "base analog" refers to a heterocyclic moiety which is located at the 1' position of a nucleotide sugar moiety in a modified nucleotide that can be incorporated into a nucleic acid duplex (or the equivalent position in a nucleotide sugar moiety substitution that can be incorporated into a nucleic acid duplex). In the dsRNAs of the invention, a base analog is generally either a purine or pyrimidine base excluding the common bases guanine (G), cytosine (C), adenine (A), thymine (T), and uracil (U). Base analogs can duplex with other bases or base analogs in dsRNAs. Base analogs include those useful in the compounds and methods of the invention, e.g., those disclosed in U.S. Pat. Nos. 5,432,272 and 6,001,983 to Benner and US Patent Publication No. 20080213891 to Manoharan, which are herein incorporated by reference. Non-limiting examples of bases include hypoxanthine (I), xanthine (X), 3β-D-ribofuranosyl-(2,6-diaminopyrimidine) (K), 3-β-D-ribofuranosyl-(1-methyl-pyrazolo[4,3-d]pyrimidine-5,7(4H,6H)-dione) (P), iso-cytosine (iso-C), iso-guanine (iso-G), 1-β-D-ribofuranosyl-(5-nitroindole), 1-β-D-ribofuranosyl-(3-nitropyrrole), 5-bromouracil, 2-aminopurine, 4-thio-dT, 7-(2-thienyl)-imidazo[4,5-b]pyridine (Ds) and pyrrole-2-carbaldehyde (Pa), 2-amino-6-(2-thienyl)purine (S), 2-oxopyridine (Y), difluorotolyl, 4-fluoro-6-methylbenzimidazole, 4-methylbenzimidazole, 3-methyl isocarbostyrilyl, 5-methyl isocarbostyrilyl, and 3-methyl-7-propynyl isocarbostyrilyl, 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof (Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am. Chem. Soc., 122(6):1001-1007 (2000); McMinn et al., J. Am. Chem. Soc., 121:11585-11586 (1999); Guckian et al., J. Org. Chem., 63:9652-9656 (1998); Moran et al., Proc. Natl. Acad. Sci., 94:10506-10511 (1997); Das et al., J. Chem. Soc., Perkin Trans., 1:197-206 (2002); Shibata et al., J. Chem. Soc., Perkin Trans., 1: 1605-1611 (2001); Wu et al., J. Am. Chem. Soc., 122(32):7621-7632 (2000); O'Neill et al., J. Org. Chem., 67:5869-5875 (2002); Chaudhuri et al., J. Am. Chem. Soc., 117:10434-10442 (1995); and U.S. Pat. No. 6,218,108). Base analogs may also be a universal base.

As used herein, "universal base" refers to a heterocyclic moiety located at the 1' position of a nucleotide sugar moiety in a modified nucleotide, or the equivalent position in a nucleotide sugar moiety substitution, that, when present in a nucleic acid duplex, can be positioned opposite more than one type of base without altering the double helical structure (e.g., the structure of the phosphate backbone). Additionally, the universal base does not destroy the ability of the single stranded nucleic acid in which it resides to duplex to a target nucleic acid. The ability of a single stranded nucleic acid containing a universal base to duplex a target nucleic can be assayed by methods apparent to one in the art (e.g., UV absorbance, circular dichroism, gel shift, single stranded nuclease sensitivity, etc.). Additionally, conditions under which duplex formation is observed may be varied to determine duplex stability or formation, e.g., temperature, as melting temperature (Tm) correlates with the stability of nucleic acid duplexes. Compared to a reference single stranded nucleic acid that is exactly complementary to a target nucleic acid, the single stranded nucleic acid containing a universal base forms a duplex with the target nucleic acid that has a lower Tm than a duplex formed with the complementary nucleic acid. However, compared to a reference single stranded nucleic acid in which the universal base has been replaced with a base to generate a single mismatch, the single stranded nucleic acid containing the universal base forms a duplex with the target nucleic acid that has a higher Tm than a duplex formed with the nucleic acid having the mismatched base.

Some universal bases are capable of base pairing by forming hydrogen bonds between the universal base and all of the bases guanine (G), cytosine (C), adenine (A), thymine (T), and uracil (U) under base pair forming conditions. A universal base is not a base that forms a base pair with only one single complementary base. In a duplex, a universal base may form no hydrogen bonds, one hydrogen bond, or more than one hydrogen bond with each of G, C, A, T, and U opposite to it on the opposite strand of a duplex. Preferably, the universal bases does not interact with the base opposite to it on the opposite strand of a duplex. In a duplex, base pairing between a universal base occurs without altering the double helical structure of the phosphate backbone. A universal base may also interact with bases in adjacent nucleotides on the same nucleic acid strand by stacking interactions. Such stacking interactions stabilize the duplex, especially in situations where the universal base does not form any hydrogen bonds with the base positioned opposite to it on the opposite strand of the duplex. Non-limiting examples of universal-binding nucleotides include inosine, 1-β-D-ribofuranosyl-5-nitroindole, and/or 1-β-D-ribofuranosyl-3-nitropyrrole (US Pat. Appl. Publ. No. 20070254362 to Quay et al.; Van Aerschot et al., An acyclic 5-nitroindazole nucleoside analogue as ambiguous nucleoside. Nucleic Acids Res. 1995 Nov. 11; 23(21):4363-70; Loakes et al., 3-Nitropyrrole and 5-nitroindole as universal bases in primers for DNA sequencing and PCR. Nucleic Acids Res. 1995 Jul. 11; 23(13):2361-6; Loakes and Brown, 5-Nitroindole as an universal base analogue. Nucleic Acids Res. 1994 Oct. 11; 22(20):4039-43).

As used herein, "loop" refers to a structure formed by a single strand of a nucleic acid, in which complementary regions that flank a particular single stranded nucleotide region hybridize in a way that the single stranded nucleotide region between the complementary regions is excluded from duplex formation or Watson-Crick base pairing. A loop is a single stranded nucleotide region of any length. Examples of loops include the unpaired nucleotides present in such structures as hairpins, stem loops, or extended loops.

As used herein, "extended loop" in the context of a dsRNA refers to a single stranded loop and in addition 1, 2, 3, 4, 5, 6 or up to 20 base pairs or duplexes flanking the loop. In an extended loop, nucleotides that flank the loop on the 5' side form a duplex with nucleotides that flank the loop on the 3' side. An extended loop may form a hairpin or stem loop.

As used herein, "tetraloop" in the context of a dsRNA refers to a loop (a single stranded region) consisting of four nucleotides that forms a stable secondary structure that contributes to the stability of an adjacent Watson-Crick hybridized nucleotides. Without being limited to theory, a tetraloop may stabilize an adjacent Watson-Crick base pair by stacking interactions. In addition, interactions among the four nucleotides in a tetraloop include but are not limited to non-Watson-Crick base pairing, stacking interactions, hydrogen bonding, and contact interactions (Cheong et al., *Nature* 1990 Aug. 16; 346(6285):680-2; Heus and Pardi, *Science* 1991 Jul. 12; 253(5016):191-4). A tetraloop confers an increase in the melting temperature (Tm) of an adjacent duplex that is higher than expected from a simple model loop sequence consisting of four random bases. For example, a tetraloop can confer a melting temperature of at least 55° C. in 10 mM $NaHPO_4$ to a hairpin comprising a duplex of at least 2 base pairs in length. A tetraloop may contain ribonucleotides, deoxyribonucleotides, modified nucleotides, and combinations thereof. Examples of RNA tetraloops include the UNCG family of tetraloops (e.g., UUCG), the GNRA family of tetraloops (e.g., GAAA), and the CUUG tetraloop. (Woese et al., Proc Natl Acad Sci USA. 1990 November; 87(21):8467-71; Antao et al., Nucleic Acids Res. 1991 Nov. 11; 19(21):5901-5). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, the d(TNCG) family of tetraloops (e.g., d(TTCG)). (Nakano et al. Biochemistry, 41 (48), 14281-14292, 2002; SHINJI et al. Nippon Kagakkai Koen Yokoshu VOL. 78th; NO. 2; PAGE. 731 (2000)).

As used herein, the term "siRNA" refers to a double stranded nucleic acid in which each strand comprises RNA, RNA analog(s) or RNA and DNA. The siRNA comprises between 19 and 23 nucleotides or comprises 21 nucleotides. The siRNA typically has 2 bp overhangs on the 3' ends of each strand such that the duplex region in the siRNA comprises 17-21 nucleotides, or 19 nucleotides. Typically, the antisense strand of the siRNA is sufficiently complementary with the target sequence of the HIF-1α gene/RNA.

An anti-HIF-1α DsiRNA of the instant invention possesses strand lengths of at least 25 nucleotides. Accordingly, in certain embodiments, an anti-HIF-1α DsiRNA contains one oligonucleotide sequence, a first sequence, that is at least 25 nucleotides in length and no longer than 35 or up to 50 or more nucleotides. This sequence of RNA can be between 26 and 35, 26 and 34, 26 and 33, 26 and 32, 26 and 31, 26 and 30, and 26 and 29 nucleotides in length. This sequence can be 27 or 28 nucleotides in length or 27 nucleotides in length. The second sequence of the DsiRNA agent can be a sequence that anneals to the first sequence under biological conditions, such as within the cytoplasm of a eukaryotic cell. Generally, the second oligonucleotide sequence will have at least 19 complementary base pairs with the first oligonucleotide sequence, more typically the second oligonucleotide sequence will have 21 or more complementary base pairs, or 25 or more complementary base pairs with the first oligonucleotide sequence. In one embodiment, the second sequence is the same length as the first sequence, and the DsiRNA agent is blunt ended. In another embodiment, the ends of the DsiRNA agent have one or more overhangs.

In certain embodiments, the first and second oligonucleotide sequences of the DsiRNA agent exist on separate oligonucleotide strands that can be and typically are chemically synthesized. In some embodiments, both strands are between 26 and 35 nucleotides in length. In other embodiments, both strands are between 25 and 30 or 26 and 30 nucleotides in length. In one embodiment, both strands are 27 nucleotides in length, are completely complementary and have blunt ends. In certain embodiments of the instant invention, the first and second sequences of an anti-HIF-1α DsiRNA exist on separate RNA oligonucleotides (strands). In one embodiment, one or both oligonucleotide strands are capable of serving as a substrate for Dicer. In other embodiments, at least one modification is present that promotes Dicer to bind to the double-stranded RNA structure in an orientation that maximizes the double-stranded RNA structure's effectiveness in inhibiting gene expression. In certain embodiments of the instant invention, the anti-HIF-1α DsiRNA agent is comprised of two oligonucleotide strands of differing lengths, with the anti-HIF-1α DsiRNA possessing a blunt end at the 3' terminus of a first strand (sense strand) and a 3' overhang at the 3' terminus of a second strand (antisense strand). The DsiRNA can also contain one or more deoxyribonucleic acid (DNA) base substitutions.

Suitable DsiRNA compositions that contain two separate oligonucleotides can be chemically linked outside their annealing region by chemical linking groups. Many suitable chemical linking groups are known in the art and can be used. Suitable groups will not block Dicer activity on the DsiRNA and will not interfere with the directed destruction of the RNA transcribed from the target gene. Alternatively, the two separate oligonucleotides can be linked by a third oligonucleotide such that a hairpin structure is produced upon annealing of the two oligonucleotides making up the DsiRNA composition. The hairpin structure will not block Dicer activity on the DsiRNA and will not interfere with the directed destruction of the target RNA.

As used herein, a dsRNA, e.g., DsiRNA or siRNA, having a sequence "sufficiently complementary" to a target RNA or cDNA sequence (e.g., HIF-1α mRNA) means that the dsRNA has a sequence sufficient to trigger the destruction of the target RNA (where a cDNA sequence is recited, the RNA sequence corresponding to the recited cDNA sequence) by the RNAi machinery (e.g., the RISC complex) or process. For example, a dsRNA that is "sufficiently complementary" to a target RNA or cDNA sequence to trigger the destruction of the target RNA by the RNAi machinery or process can be identified as a dsRNA that causes a detectable reduction in the level of the target RNA in an appropriate assay of dsRNA activity (e.g., an in vitro assay as described in Example 2 below), or, in further examples, a dsRNA that is sufficiently complementary to a target RNA or cDNA sequence to trigger the destruction of the target RNA by the RNAi machinery or process can be identified as a dsRNA that produces at least a 5%, at least a 10%, at least a 15%, at least a 20%, at least a 25%, at least a 30%, at least a 35%, at least a 40%, at least a 45%, at least a 50%, at least a 55%, at least a 60%, at least a 65%, at least a 70%, at least a 75%, at least a 80%, at least a 85%, at least a 90%, at least a 95%, at least a 98% or at least a 99% reduction in the level of the target RNA in an appropriate assay of dsRNA activity. In additional examples, a dsRNA that is sufficiently complementary to a target RNA or cDNA sequence to trigger the destruction of the target RNA by the RNAi machinery or process can be identified based upon assessment of the duration of a certain level of inhibitory activity with respect to the target RNA or protein levels in a cell or organism. For example, a dsRNA that is sufficiently complementary to a target RNA or cDNA sequence to trigger the destruction of the target RNA by the RNAi machinery or process can be identified as a dsRNA capable of reducing target mRNA levels by at least 20% at least 48 hours post-administration of said dsRNA to a cell or organism. Preferably, a dsRNA that is sufficiently complementary to a target RNA or cDNA sequence to trigger the destruction of the target RNA by the RNAi machinery or process is identified as a dsRNA capable of reducing target mRNA levels by at least 40% at least 72 hours post-administration of said dsRNA to a cell or organism, by at least 40% at least four, five or seven days post-administration of said dsRNA to a cell or organism, by at least 50% at least 48 hours post-administration of said dsRNA to a cell or organism, by at least 50% at least 72 hours post-administration of said dsRNA to a cell or organism, by at least 50% at least four, five or seven days post-administration of said dsRNA to a cell or organism, by at least 80% at least 48 hours post-administration of said dsRNA to a cell or organism, by at least 80% at least 72 hours post-administration of said dsRNA to a cell or organism, or by at least 80% at least four, five or seven days post-administration of said dsRNA to a cell or organism.

The dsRNA molecule can be designed such that every residue of the antisense strand is complementary to a residue in the target molecule. Alternatively, substitutions can be made within the molecule to increase stability and/or enhance processing activity of said molecule. Substitutions can be made within the strand or can be made to residues at the ends of the strand. In certain embodiments, substitutions and/or modifications are made at specific residues within a DsiRNA agent. Such substitutions and/or modifications can include, e.g., deoxy-modifications at one or more residues of positions 1, 2 and 3 when numbering from the 3' terminal position of the sense strand of a DsiRNA agent; and introduction of 2'-O-alkyl (e.g., 2'-O-methyl) modifications at the 3' terminal residue of the antisense strand of DsiRNA agents, with such modifications also being performed at overhang positions of the 3' portion of the antisense strand and at alternating residues of the antisense strand of the DsiRNA that are included within the region of a DsiRNA agent that is processed to form an active siRNA agent. The preceding modifications are offered as exemplary, and are not intended to be limiting in any manner. Further consideration of the structure of preferred DsiRNA agents, including further description of the modifications and substitutions that can be performed upon the anti-HIF-1α DsiRNA agents of the instant invention, can be found below.

Where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

The term "double-stranded RNA" or "dsRNA", as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where separate RNA molecules, such dsRNA are often referred to as siRNA ("short interfering RNA") or DsiRNA ("Dicer substrate siRNAs"). Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5' end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In addition, as used herein, "dsRNA" may include chemical modifications to ribonucleotides, internucleoside linkages, end-groups, caps, and conjugated moieties, including substantial modifications at multiple nucleotides and including all types of modifications disclosed herein or known in the art. Any such modifications, as used in an siRNA- or DsiRNA-type molecule, are encompassed by "dsRNA" for the purposes of this specification and claims.

The phrase "duplex region" refers to the region in two complementary or substantially complementary oligonucleotides that form base pairs with one another, either by Watson-Crick base pairing or other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

Single-stranded nucleic acids that base pair over a number of bases are said to "hybridize." Hybridization is typically determined under physiological or biologically relevant conditions (e.g., intracellular: pH 7.2, 140 mM potassium ion; extracellular pH 7.4, 145 mM sodium ion). Hybridization conditions generally contain a monovalent cation and biologically acceptable buffer and may or may not contain a divalent cation, complex anions, e.g. gluconate from potassium gluconate, uncharged species such as sucrose, and inert polymers to reduce the activity of water in the sample, e.g. PEG. Such conditions include conditions under which base pairs can form.

Hybridization is measured by the temperature required to dissociate single stranded nucleic acids forming a duplex, i.e., (the melting temperature; Tm). Hybridization conditions are also conditions under which base pairs can form. Various conditions of stringency can be used to determine hybridization (see, e.g., Wahl, G. M. and S. L. Berger (1987) Methods Enzymol. 152:399; Kimmel, A. R. (1987) Methods Enzymol. 152:507). Stringent temperature conditions will ordinarily include temperatures of at least about 30° C., more preferably of at least about 37° C., and most preferably of at least about 42° C. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). For example, a hybridization determination buffer is shown in Table 1.

TABLE 1

|  | final conc. | Vender | Cat# | Lot# | m.w./Stock | To make 50 mL solution |
|---|---|---|---|---|---|---|
| NaCl | 100 mM | Sigma | S-5150 | 41K8934 | 5M | 1 mL |
| KCl | 80 mM | Sigma | P-9541 | 70K0002 | 74.55 | 0.298 g |
| MgCl$_2$ | 8 mM | Sigma | M-1028 | 120K8933 | 1M | 0.4 mL |
| sucrose | 2% w/v | Fisher | BP220-212 | 907105 | 342.3 | 1 g |
| Tris-HCl | 16 mM | Fisher | BP1757-500 | 12419 | 1M | 0.8 mL |
| NaH$_2$PO$_4$ | 1 mM | Sigma | S-3193 | 52H-029515 | 120.0 | 0.006 g |
| EDTA | 0.02 mM | Sigma | E-7889 | 110K89271 | 0.5M | 2 µL |
| H$_2$O |  | Sigma | W-4502 | 51K2359 |  | to 50 mL |
| pH = 7.0 at 20° C. |  |  |  | adjust with HCl |  |  |

Useful variations on hybridization conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Antisense to Molecular Cloning Techniques, 1987, Academic Press, New York); and Sambrook et al., Molecular Cloning: A Laboratory Manual, Cold Spring Harbor Laboratory Press, New York.

As used herein, "oligonucleotide strand" is a single stranded nucleic acid molecule. An oligonucleotide may comprise ribonucleotides, deoxyribonucleotides, modified nucleotides (e.g., nucleotides with 2' modifications, synthetic base analogs, etc.) or combinations thereof. Such modified oligonucleotides can be preferred over native forms because of properties such as, for example, enhanced cellular uptake and increased stability in the presence of nucleases.

As used herein, the term "ribonucleotide" encompasses natural and synthetic, unmodified and modified ribonucleotides. Modifications include changes to the sugar moiety, to the base moiety and/or to the linkages between ribonucleotides in the oligonucleotide. As used herein, the term "ribonucleotide" specifically excludes a deoxyribonucleotide, which is a nucleotide possessing a single proton group at the 2' ribose ring position.

As used herein, the term "deoxyribonucleotide" encompasses natural and synthetic, unmodified and modified deoxyribonucleotides. Modifications include changes to the sugar moiety, to the base moiety and/or to the linkages between deoxyribonucleotide in the oligonucleotide. As used herein, the term "deoxyribonucleotide" also includes a modified ribonucleotide that does not permit Dicer cleavage of a dsRNA agent, e.g., a 2'-O-methyl ribonucleotide, a phosphorothioate-modified ribonucleotide residue, etc., that does not permit Dicer cleavage to occur at a bond of such a residue.

As used herein, the term "PS-NA" refers to a phosphorothioate-modified nucleotide residue. The term "PS-NA"

therefore encompasses both phosphorothioate-modified ribonucleotides ("PS-RNAs") and phosphorothioate-modified deoxyribonucleotides ("PS-DNAs").

As used herein, "Dicer" refers to an endoribonuclease in the RNase III family that cleaves a dsRNA or dsRNA-containing molecule, e.g., double-stranded RNA (dsRNA) or pre-microRNA (miRNA), into double-stranded nucleic acid fragments 19-25 nucleotides long, usually with a two-base overhang on the 3' end. With respect to certain dsRNAs of the invention (e.g., "DsiRNAs"), the duplex formed by a dsRNA region of an agent of the invention is recognized by Dicer and is a Dicer substrate on at least one strand of the duplex. Dicer catalyzes the first step in the RNA interference pathway, which consequently results in the degradation of a target RNA. The protein sequence of human Dicer is provided at the NCBI database under accession number NP_085124, hereby incorporated by reference.

Dicer "cleavage" can be determined as follows (e.g., see Collingwood et al., Oligonucleotides 18:187-200 (2008)). In a Dicer cleavage assay, RNA duplexes (100 pmol) are incubated in 20 μL of 20 mM Tris pH 8.0, 200 mM NaCl, 2.5 mM MgCl2 with or without 1 unit of recombinant human Dicer (Stratagene, La Jolla, Calif.) at 37° C. for 18-24 hours. Samples are desalted using a Performa SR 96-well plate (Edge Biosystems, Gaithersburg, Md.). Electrospray-ionization liquid chromatography mass spectroscopy (ESI-LCMS) of duplex RNAs pre- and post-treatment with Dicer is done using an Oligo HTCS system (Novatia, Princeton, N.J.; Hail et al., 2004), which consists of a ThermoFinnigan TSQ7000, Xcalibur data system, ProMass data processing software and Paradigm MS4 HPLC (Michrom BioResources, Auburn, Calif.). In this assay, Dicer cleavage occurs where at least 5%, 10%, 20%, 30%, 40%, 50%, 60%, 70%, 80%, 90%, 95%, or even 100% of the Dicer substrate dsRNA, (i.e., 25-30 bp, dsRNA, preferably 26-30 bp dsRNA) is cleaved to a shorter dsRNA (e.g., 19-23 bp dsRNA, preferably, 21-23 bp dsRNA).

Figure 1:
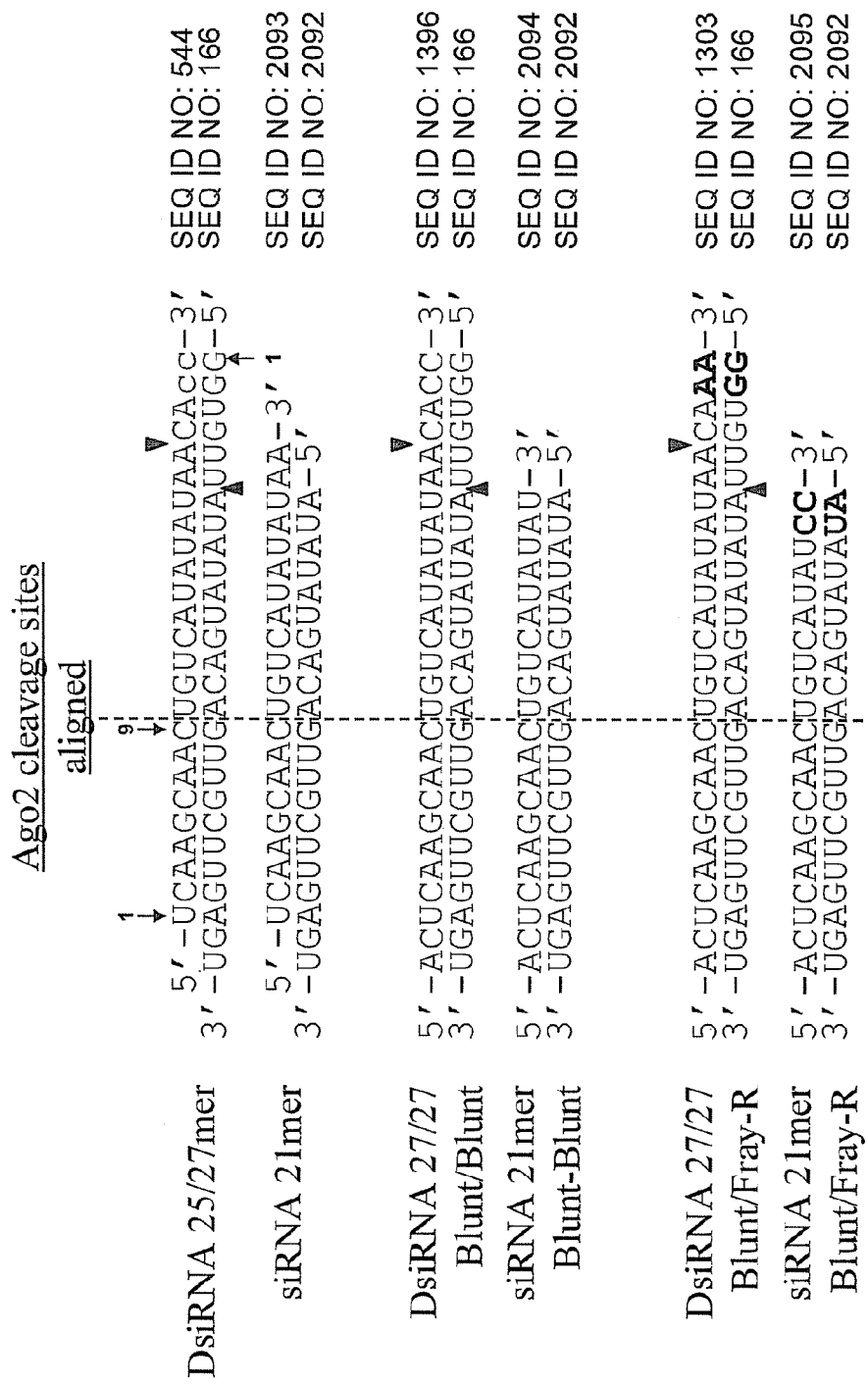
FIG. 1 shows the structures of exemplary DsiRNA agents of the invention targeting a site in the HIF-1α RNA referred to herein as the "HIF-1α-1385" target site. UPPER case=unmodified RNA, lower case=DNA, Bold=mismatch base pair nucleotides; arrowheads indicate projected Dicer enzyme cleavage sites; dashed line indicates sense strand (top strand) sequences corresponding to the projected Argonaute 2 (Ago2) cleavage site within the targeted HIF-1α sequence.
Figure 2A:
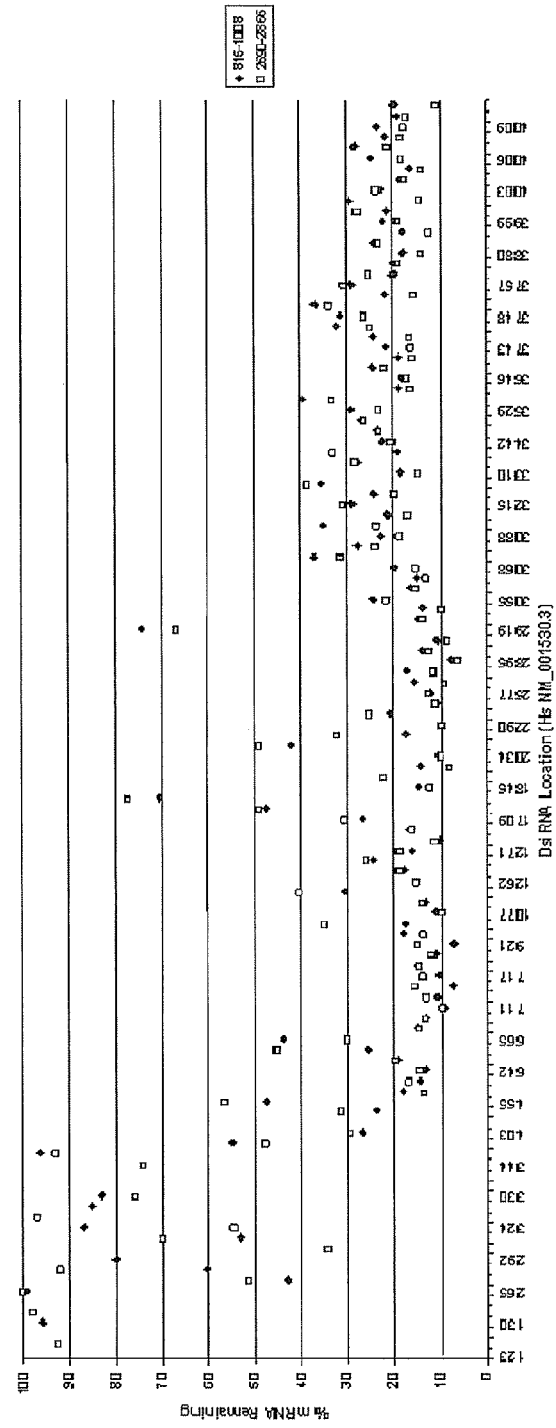
FIGS. 2A to 2D present primary screen data showing DsiRNA-mediated knockdown of human HIF-1α (FIGS. 2A and 2B) and mouse HIF-1α (FIGS. 2C and 2D) in human and mouse cells, respectively. For each DsiRNA tested, two independent qPCR amplicons were assayed (in human cells, amplicons "815-1008" and "2690-2866" were assayed, while in mouse cells, amplicons "1055-1223" and "2463-2593" were assayed). The boxed region of FIG. 2D indicates a series of assays known to have been affected by sub-optimal transfection conditions.
Figure 2B:
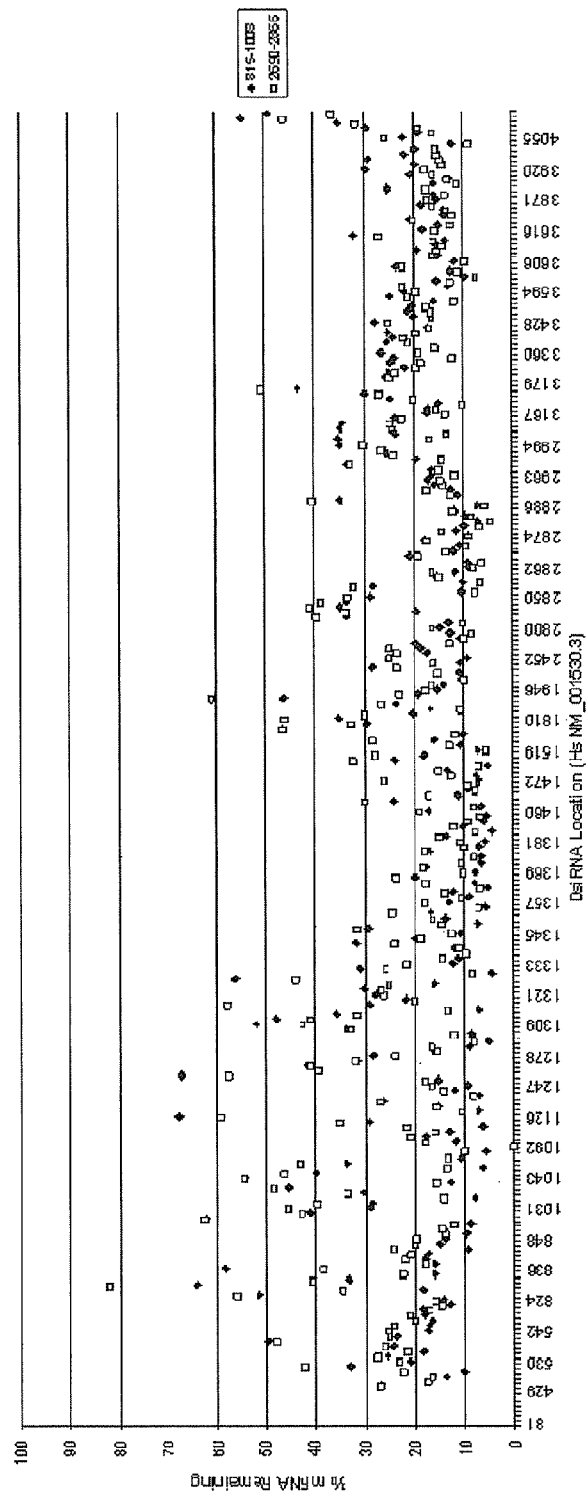
Figure 2C:
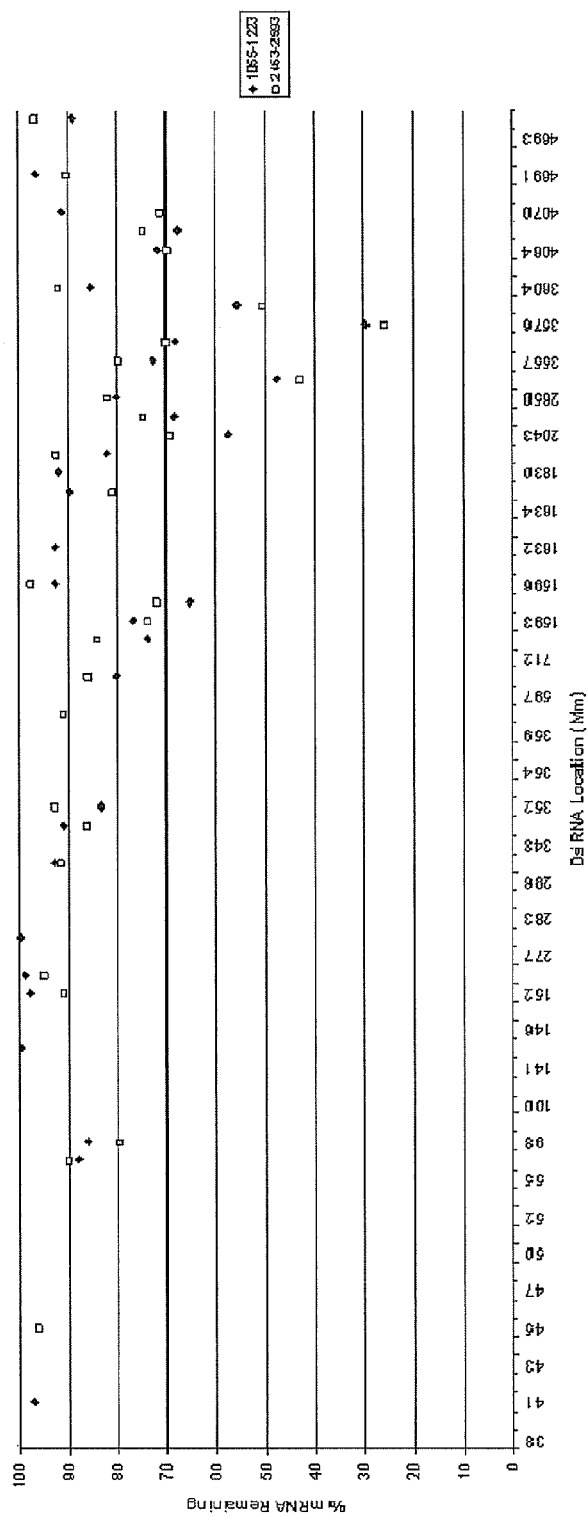
Figure 2D:
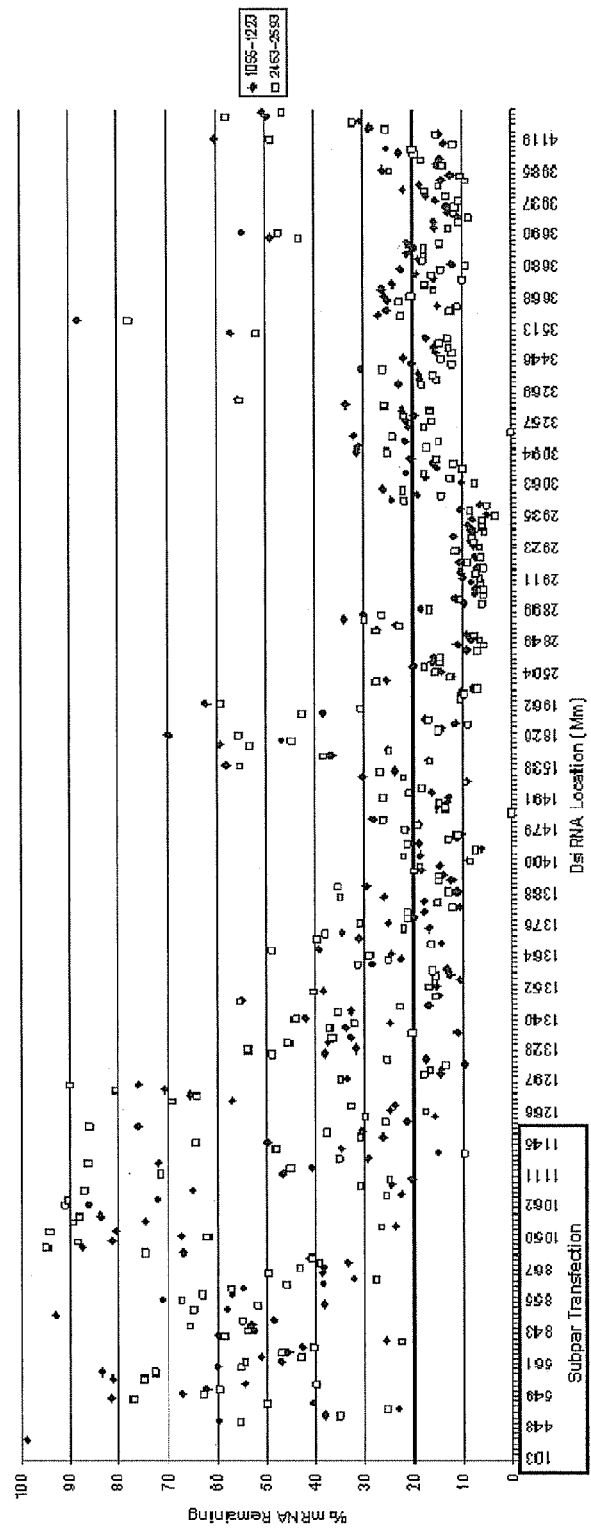

As used herein, "Dicer cleavage site" refers to the sites at which Dicer cleaves a dsRNA (e.g., the dsRNA region of a DsiRNA agent of the invention). Dicer contains two RNase III domains which typically cleave both the sense and antisense strands of a dsRNA. The average distance between the RNase III domains and the PAZ domain determines the length of the short double-stranded nucleic acid fragments it produces and this distance can vary (Macrae et al. (2006) *Science* 311: 195-8). As shown in FIG. 1, Dicer is projected to cleave certain double-stranded ribonucleic acids of the instant invention that possess an antisense strand having a 2 nucleotide 3' overhang at a site between the $21^{st}$ and $22^{nd}$ nucleotides removed from the 3' terminus of the antisense strand, and at a corresponding site between the $21^{st}$ and $22^{nd}$ nucleotides removed from the 5' terminus of the sense strand. The projected and/or prevalent Dicer cleavage site(s) for dsRNA molecules distinct from those depicted in FIG. 1 may be similarly identified via art-recognized methods, including those described in Macrae et al. While the Dicer cleavage events depicted in FIG. 1 generate 21 nucleotide siRNAs, it is noted that Dicer cleavage of a dsRNA (e.g., DsiRNA) can result in generation of Dicer-processed siRNA lengths of 19 to 23 nucleotides in length. Indeed, in certain embodiments, a double-stranded DNA region may be included within a dsRNA for purpose of directing prevalent Dicer excision of a typically non-preferred 19mer or 20mer siRNA, rather than a 21mer.

As used herein, "overhang" refers to unpaired nucleotides, in the context of a duplex having one or more free ends at the 5' terminus or 3' terminus of a dsRNA. In certain embodiments, the overhang is a 3' or 5' overhang on the antisense strand or sense strand. In some embodiments, the overhang is a 3' overhang having a length of between one and six nucleotides, optionally one to five, one to four, one to three, one to two, two to six, two to five, two to four, two to three, three to six, three to five, three to four, four to six, four to five, five to six nucleotides, or one, two, three, four, five or six nucleotides. "Blunt" or "blunt end" means that there are no unpaired nucleotides at that end of the dsRNA, i.e., no nucleotide overhang. For clarity, chemical caps or non-nucleotide chemical moieties conjugated to the 3' end or 5' end of an siRNA are not considered in determining whether an siRNA has an overhang or is blunt ended. In certain embodiments, the invention provides a dsRNA molecule for inhibiting the expression of the HIF-1α target gene in a cell or mammal, wherein the dsRNA comprises an antisense strand comprising a region of complementarity which is complementary to at least a part of an mRNA formed in the expression of the HIF-1α target gene, and wherein the region of complementarity is less than 35 nucleotides in length, optionally 19-24 nucleotides in length or 25-30 nucleotides in length, and wherein the dsRNA, upon contact with a cell expressing the HIF-1α target gene, inhibits the expression of the HIF-1α target gene by at least 10%, 25%, or 40%.

A dsRNA of the invention comprises two RNA strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the HIF-1α target gene, the other strand (the sense strand) comprises a region which is complementary to the antisense strand, such that the two strands hybridize and form a duplex structure when combined under suitable conditions. Generally, the duplex structure is between 15 and 35, optionally between 25 and 30, between 26 and 30, between 18 and 25, between 19 and 24, or between 19 and 21 base pairs in length. Similarly, the region of complementarity to the target sequence is between 15 and 35, optionally between 18 and 30, between 25 and 30, between 19 and 24, or between 19 and 21 nucleotides in length. The dsRNA of the invention may further comprise one or more single-stranded nucleotide overhang(s). It has been identified that dsRNAs comprising duplex structures of between 15 and 35 base pairs in length can be effective in inducing RNA interference, including DsiRNAs (generally of at least 25 base pairs in length) and siRNAs (in certain embodiments, duplex structures of siRNAs are between 20 and 23, and optionally, specifically 21 base pairs (Elbashir et al., *EMBO* 20: 6877-6888)). It has also been identified that dsRNAs possessing duplexes shorter than 20 base pairs can be effective as well (e.g., 15, 16, 17, 18 or 19 base pair duplexes). In certain embodiments, the dsRNAs of the invention can comprise at least one strand of a length of 19 nucleotides or more. In certain embodiments, it can be reasonably expected that shorter dsRNAs comprising a sequence complementary to one of the sequences of Table 5, minus only a few nucleotides on one or both ends may be similarly effective as compared to the dsRNAs described above and in Tables 2-4 and 6-7. Hence, dsRNAs comprising a partial sequence of at least 15, 16, 17, 18, 19, 20, or more contiguous nucleotides sufficiently complementary to one of the sequences of Table 5, and differing in their ability to inhibit the expression of the HIF-1α target gene in an assay as described herein by not more than 5, 10, 15, 20, 25, or 30% inhibition from a dsRNA comprising the full sequence, are contemplated by the invention. In one embodiment, at least one end of the dsRNA has a single-stranded nucleotide overhang of 1 to 5, optionally 1 to 4, in certain embodiments, 1 or 2 nucleotides. Certain dsRNA structures having at least one nucleotide overhang possess superior inhibitory properties as compared to counterparts possessing base-paired blunt ends at both ends of the dsRNA molecule.

As used herein, the term "RNA processing" refers to processing activities performed by components of the siRNA, miRNA or RNase H pathways (e.g., Drosha, Dicer, Argonaute2 or other RISC endoribonucleases, and RNaseH), which are described in greater detail below (see "RNA Processing" section below). The term is explicitly distinguished from the post-transcriptional processes of 5' capping of RNA and degradation of RNA via non-RISC- or non-RNase H-mediated processes. Such "degradation" of an RNA can take several forms, e.g. deadenylation (removal of a 3' poly(A) tail), and/or nuclease digestion of part or all of the body of the RNA by one or more of several endo- or exo-nucleases (e.g., RNase III, RNase P, RNase T1, RNase A (1, 2, 3, 4/5), oligonucleotidase, etc.).

By "homologous sequence" is meant, a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.). Indeed, design and use of the dsRNA agents of the instant invention contemplates the possibility of using such dsRNA agents not only against target RNAs of HIF-1α possessing perfect complementarity with the presently described dsRNA agents, but also against target HIF-1α RNAs possessing sequences that are, e.g., only 99%, 98%, 97%, 96%, 95%, 94%, 93%, 92%, 91%, 90%, 89%, 88%, 87%, 86%, 85%, 84%, 83%, 82%, 81%, 80% etc. complementary to said dsRNA agents. Similarly, it is contemplated that the presently described dsRNA agents of the instant invention might be readily altered by the skilled artisan to enhance the extent of complementarity between said dsRNA agents and a target HIF-1α RNA, e.g., of a specific allelic variant of HIF-1α (e.g., an allele of enhanced therapeutic interest). Indeed, dsRNA agent sequences with insertions, deletions, and single point mutations relative to the target HIF-1α sequence can also be effective for inhibition. Alternatively, dsRNA agent sequences with nucleotide analog substitutions or insertions can be effective for inhibition.

Sequence identity may be determined by sequence comparison and alignment algorithms known in the art. To determine the percent identity of two nucleic acid sequences (or of two amino acid sequences), the sequences are aligned for comparison purposes (e.g., gaps can be introduced in the first sequence or second sequence for optimal alignment). The nucleotides (or amino acid residues) at corresponding nucleotide (or amino acid) positions are then compared. When a position in the first sequence is occupied by the same residue as the corresponding position in the second sequence, then the molecules are identical at that position. The percent identity between the two sequences is a function of the number of identical positions shared by the sequences (i.e., % homology=# of identical positions/total # of positions×100), optionally penalizing the score for the number of gaps introduced and/or length of gaps introduced.

The comparison of sequences and determination of percent identity between two sequences can be accomplished using a mathematical algorithm. In one embodiment, the alignment generated over a certain portion of the sequence aligned having sufficient identity but not over portions having low degree of identity (i.e., a local alignment). A preferred, non-limiting example of a local alignment algorithm utilized for the comparison of sequences is the algorithm of Karlin and Altschul (1990) Proc. Natl. Acad. Sci. USA 87:2264-68, modified as in Karlin and Altschul (1993) Proc. Natl. Acad. Sci. USA 90:5873-77. Such an algorithm is incorporated into the BLAST programs (version 2.0) of Altschul, et al. (1990) J. Mol. Biol. 215:403-10.

In another embodiment, a gapped alignment the alignment is optimized is formed by introducing appropriate gaps, and percent identity is determined over the length of the aligned sequences (i.e., a gapped alignment). To obtain gapped alignments for comparison purposes, Gapped BLAST can be utilized as described in Altschul et al., (1997) Nucleic Acids Res. 25(17):3389-3402. In another embodiment, a global alignment the alignment is optimized is formed by introducing appropriate gaps, and percent identity is determined over the entire length of the sequences aligned. (i.e., a global alignment). A preferred, non-limiting example of a mathematical algorithm utilized for the global comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used.

Greater than 80% sequence identity, e.g., 80%, 81%, 82%, 83%, 84%, 85%, 86%, 87%, 88%, 89%, 90%, 91%, 92%, 93%, 94%, 95%, 96%, 97%, 98%, 99% or even 100% sequence identity, between the dsRNA antisense strand and the portion of the HIF-1α RNA sequence is preferred. Alternatively, the dsRNA may be defined functionally as a nucleotide sequence (or oligonucleotide sequence) that is capable of hybridizing with a portion of the HIF-1α RNA (e.g., 400 mM NaCl, 40 mM PIPES pH 6.4, 1 mM EDTA, 50° C. or 70° C. hybridization for 12-16 hours; followed by washing). Additional preferred hybridization conditions include hybridization at 70° C. in 1×SSC or 50° C. in 1×SSC, 50% formamide followed by washing at 70° C. in 0.3×SSC or hybridization at 70° C. in 4×SSC or 50° C. in 4×SSC, 50% formamide followed by washing at 67° C. in 1×SSC. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, $Tm(°C.)=2(\# \text{ of } A+T \text{ bases})+4(\# \text{ of } G+C \text{ bases})$. For hybrids between 18 and 49 base pairs in length, $Tm(°C.)=81.5+16.6(\log 10[Na+])+0.41 (\% G+C)-(600/N)$, where N is the number of bases in the hybrid, and [Na+] is the concentration of sodium ions in the hybridization buffer ([Na+] for 1×SSC=0.165 M). Additional examples of stringency conditions for polynucleotide hybridization are provided in Sambrook, J., E. F. Fritsch, and T. Maniatis, 1989, Molecular Cloning: A Laboratory Manual, Cold Spring Harbor Laboratory Press, Cold Spring Harbor, N.Y., chapters 9 and 11, and Current Protocols in Molecular Biology, 1995, F.

M. Ausubel et al., eds., John Wiley & Sons, Inc., sections 2.10 and 6.3-6.4. The length of the identical nucleotide sequences may be at least 10, 12, 15, 17, 20, 22, 25, 27 or 30 bases.

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a dsRNA molecule having complementarity to an antisense region of the dsRNA molecule. In addition, the sense region of a dsRNA molecule can comprise a nucleic acid sequence having homology with a target nucleic acid sequence.

By "antisense region" is meant a nucleotide sequence of a dsRNA molecule having complementarity to a target nucleic acid sequence. In addition, the antisense region of a dsRNA molecule comprises a nucleic acid sequence having complementarity to a sense region of the dsRNA molecule.

As used herein, "antisense strand" refers to a single stranded nucleic acid molecule which has a sequence complementary to that of a target RNA. When the antisense strand contains modified nucleotides with base analogs, it is not necessarily complementary over its entire length, but must at least hybridize with a target RNA.

As used herein, "sense strand" refers to a single stranded nucleic acid molecule which has a sequence complementary to that of an antisense strand. When the antisense strand contains modified nucleotides with base analogs, the sense strand need not be complementary over the entire length of the antisense strand, but must at least duplex with the antisense strand.

As used herein, "guide strand" refers to a single stranded nucleic acid molecule of a dsRNA or dsRNA-containing molecule, which has a sequence sufficiently complementary to that of a target RNA to result in RNA interference. After cleavage of the dsRNA or dsRNA-containing molecule by Dicer, a fragment of the guide strand remains associated with RISC, binds a target RNA as a component of the RISC complex, and promotes cleavage of a target RNA by RISC. As used herein, the guide strand does not necessarily refer to a continuous single stranded nucleic acid and may comprise a discontinuity, preferably at a site that is cleaved by Dicer. A guide strand is an antisense strand.

As used herein, "passenger strand" refers to an oligonucleotide strand of a dsRNA or dsRNA-containing molecule, which has a sequence that is complementary to that of the guide strand. As used herein, the passenger strand does not necessarily refer to a continuous single stranded nucleic acid and may comprise a discontinuity, preferably at a site that is cleaved by Dicer. A passenger strand is a sense strand.

By "target nucleic acid" is meant a nucleic acid sequence whose expression, level or activity is to be modulated. The target nucleic acid can be DNA or RNA. For agents that target HIF-1α, in certain embodiments, the target nucleic acid is HIF-1α RNA. HIF-1α RNA target sites can also interchangeably be referenced by corresponding cDNA sequences. Levels of HIF-1α may also be targeted via targeting of upstream effectors of HIF-1α, or the effects of modulated or misregulated HIF-1α may also be modulated by targeting of molecules downstream of HIF-1α in the HIF-1α signalling pathway.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence. In one embodiment, a dsRNA molecule of the invention comprises 19 to 30 (e.g., 19, 20, 21, 22, 23, 24, 25, 26, 27, 28, 29, or 30 or more) nucleotides that are complementary to one or more target nucleic acid molecules or a portion thereof.

In one embodiment, dsRNA molecules of the invention that down regulate or reduce HIF-1α gene expression are used for treating, preventing or reducing HIF-1α-related diseases or disorders (e.g., cancer) in a subject or organism.

In one embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (HIF-1α) nucleic acid molecule. In certain embodiments, a DsiRNA molecule of the invention possesses a length of duplexed nucleotides between 25 and 34 nucleotides in length (e.g., 25, 26, 27, 28, 29, 30, 31, 32, 33 or 34 nucleotides in length; optionally, all such nucleotides base pair with cognate nucleotides of the opposite strand). (Exemplary DsiRNA molecules of the invention are shown in FIG. 1, and below.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell. Within certain aspects, the term "cell" refers specifically to mammalian cells, such as human cells, that contain one or more isolated dsRNA molecules of the present disclosure. In particular aspects, a cell processes dsRNAs or dsRNA-containing molecules resulting in RNA interference of target nucleic acids, and contains proteins and protein complexes required for RNAi, e.g., Dicer and RISC.

In certain embodiments, dsRNAs of the invention are Dicer substrate siRNAs ("DsiRNAs"). DsiRNAs can possess certain advantages as compared to inhibitory nucleic acids that are not dicer substrates ("non-DsiRNAs"). Such advantages include, but are not limited to, enhanced duration of effect of a DsiRNA relative to a non-DsiRNA, as well as enhanced inhibitory activity of a DsiRNA as compared to a non-DsiRNA (e.g., a 19-23mer siRNA) when each inhibitory nucleic acid is suitably formulated and assessed for inhibitory activity in a mammalian cell at the same concentration (in this latter scenario, the DsiRNA would be identified as more potent than the non-DsiRNA). Detection of the enhanced potency of a DsiRNA relative to a non-DsiRNA is often most readily achieved at a formulated concentration (e.g., transfection concentration of the dsRNA) that results in the DsiRNA eliciting approximately 30-70% knockdown activity upon a target RNA (e.g., a mRNA). For active DsiRNAs, such levels of knockdown activity are most often achieved at in vitro mammalian cell DsiRNA transfection concentrations of 1 nM or less of as suitably formulated, and in certain instances are observed at DsiRNA transfection concentrations of 200 pM or less, 100 pM or less, 50 pM or less, 20 pM or less, 10 pM or less, 5 pM or less, or even 1 pM or less. Indeed, due to the variability among DsiRNAs of the precise concentration at which 30-70% knockdown of a target RNA is observed, construction of an IC50 curve via assessment of the inhibitory activity of DsiRNAs and non-DsiRNAs across a range of effective concentrations is a preferred method for detecting the enhanced potency of a DsiRNA relative to a non-DsiRNA inhibitory agent.

In certain embodiments, a DsiRNA (in a state as initially formed, prior to dicer cleavage) is more potent at reducing HIF-1α target gene expression in a mammalian cell than a 19, 20, 21, 22 or 23 base pair sequence that is contained within it. In certain such embodiments, a DsiRNA prior to dicer cleavage is more potent than a 19-21mer contained within it. Optionally, a DsiRNA prior to dicer cleavage is more potent than a 19 base pair duplex contained within it that is synthesized with symmetric dTdT overhangs (thereby forming a siRNA possessing 21 nucleotide strand lengths having dTdT overhangs). In certain embodiments, the DsiRNA is more potent than a 19-23mer siRNA (e.g., a 19 base pair duplex with dTdT overhangs) that targets at least 19 nucleotides of the 21 nucleotide target sequence that is recited for a DsiRNA of the invention (without wishing to be bound by theory, the identity of a such a target site for a DsiRNA is identified via identification of the Ago2 cleavage site for the DsiRNA; once the Ago2 cleavage site of a DsiRNA is determined for a DsiRNA, identification of the Ago2 cleavage site for any other inhibitory dsRNA can be performed and these Ago2 cleavage sites can be aligned, thereby determining the alignment of projected target nucleotide sequences for multiple dsRNAs). In certain related embodiments, the DsiRNA is more potent than a 19-23mer siRNA that targets at least 20 nucleotides of the 21 nucleotide target sequence that is recited for a DsiRNA of the invention. Optionally, the DsiRNA is more potent than a 19-23mer siRNA that targets the same 21 nucleotide target sequence that is recited for a DsiRNA of the invention. In certain embodiments, the DsiRNA is more potent than any 21mer siRNA that targets the same 21 nucleotide target sequence that is recited for a DsiRNA of the invention. Optionally, the DsiRNA is more potent than any 21 or 22mer siRNA that targets the same 21 nucleotide target sequence that is recited for a DsiRNA of the invention. In certain embodiments, the DsiRNA is more potent than any 21, 22 or 23mer siRNA that targets the same 21 nucleotide target sequence that is recited for a DsiRNA of the invention. As noted above, such potency assessments are most effectively performed upon dsRNAs that are suitably formulated (e.g., formulated with an appropriate transfection reagent) at a concentration of 1 nM or less. Optionally, an IC50 assessment is performed to evaluate activity across a range of effective inhibitory concentrations, thereby allowing for robust comparison of the relative potencies of dsRNAs so assayed.

The dsRNA molecules of the invention are added directly, or can be complexed with lipids (e.g., cationic lipids), packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. In particular embodiments, the nucleic acid molecules of the invention comprise sequences shown in FIG. 1, and the below exemplary structures. Examples of such nucleic acid molecules consist essentially of sequences defined in these figures and exemplary structures. Furthermore, where such agents are modified in accordance with the below description of modification patterning of DsiRNA agents, chemically modified forms of constructs described in FIG. 1, and the below exemplary structures can be used in all uses described for the DsiRNA agents of FIG. 1, and the below exemplary structures.

In another aspect, the invention provides mammalian cells containing one or more dsRNA molecules of this invention. The one or more dsRNA molecules can independently be targeted to the same or different sites.

By "RNA" is meant a molecule comprising at least one, and preferably at least 4, 8 and 12 ribonucleotide residues. The at least 4, 8 or 12 RNA residues may be contiguous. By "ribonucleotide" is meant a nucleotide with a hydroxyl group at the 2' position of a β-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the dsRNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the dsRNA agents of the invention can be administered. A subject can be a mammal or mammalian cells, including a human or human cells.

The phrase "pharmaceutically acceptable carrier" refers to a carrier for the administration of a therapeutic agent. Exemplary carriers include saline, buffered saline, dextrose, water, glycerol, ethanol, and combinations thereof. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. The pharmaceutically acceptable carrier of the disclosed dsRNA compositions may be micellar structures, such as a liposomes, capsids, capsoids, polymeric nanocapsules, or polymeric microcapsules.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

Various methodologies of the instant invention include step that involves comparing a value, level, feature, characteristic, property, etc. to a "suitable control", referred to interchangeably herein as an "appropriate control". A "suitable control" or "appropriate control" is a control or standard familiar to one of ordinary skill in the art useful for comparison purposes. In one embodiment, a "suitable control" or "appropriate control" is a value, level, feature, characteristic, property, etc. determined prior to performing an RNAi methodology, as described herein. For example, a transcription rate, mRNA level, translation rate, protein level, biological activity, cellular characteristic or property, genotype, phenotype, etc. can be determined prior to introducing an RNA silencing agent (e.g., DsiRNA) of the invention into a cell or organism. In another embodiment, a "suitable control" or "appropriate control" is a value, level, feature, characteristic, property, etc. determined in a cell or organism, e.g., a control or normal cell or organism, exhibiting, for example, normal traits. In yet another embodiment, a "suitable control" or "appropriate control" is a predefined value, level, feature, characteristic, property, etc.

The term "in vitro" has its art recognized meaning, e.g., involving purified reagents or extracts, e.g., cell extracts. The term "in vivo" also has its art recognized meaning, e.g., involving living cells, e.g., immortalized cells, primary cells, cell lines, and/or cells in an organism.

"Treatment", or "treating" as used herein, is defined as the application or administration of a therapeutic agent (e.g., a dsRNA agent or a vector or transgene encoding same) to a patient, or application or administration of a therapeutic agent to an isolated tissue or cell line from a patient, who has a disorder with the purpose to cure, heal, alleviate, relieve, alter, remedy, ameliorate, improve or affect the disease or disorder, or symptoms of the disease or disorder. The term "treatment" or "treating" is also used herein in the context of administering agents prophylactically. The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. The term "patient" includes human and other mammalian subjects that receive either prophylactic or therapeutic treatment.

Structures of Anti-HIF-1α DsiRNA Agents

In certain embodiments, the anti-HIF-1α DsiRNA agents of the invention can have the following structures:

In one such embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA and "Y" is an overhang domain comprised of 1-4 RNA monomers that are optionally 2'-O-methyl RNA monomers. In a related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand.

DsiRNAs of the invention can carry a broad range of modification patterns (e.g., 2'-O-methyl RNA patterns, e.g., within extended DsiRNA agents). Certain modification patterns of the second strand of DsiRNAs of the invention are presented below.

In one embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers, and "D"=DNA. The top strand is the sense strand, and the bottom strand is the antisense strand.

In another such embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In another such embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

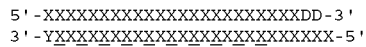

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In further embodiments, the DsiRNA comprises:

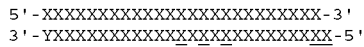

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

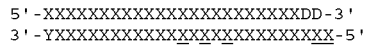

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

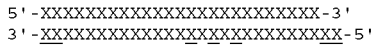

wherein "X"=RNA and "X"=2'-O-methyl RNA. In a further related embodiment, the DsiRNA comprises:

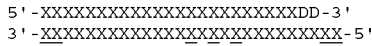

wherein "X"=RNA, "X"=2'-O-methyl RNA, and "D"=DNA. The top strand is the sense strand, and the bottom strand is the antisense strand. This modification pattern is also referred to herein as the "AS-M7" or "M7" modification pattern.
In additional embodiments, the DsiRNA comprises:

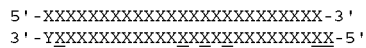

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

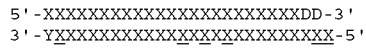

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. The top strand is the sense strand, and the bottom strand is the antisense strand.
In another related embodiment, the DsiRNA comprises:

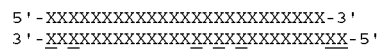

wherein "X"=RNA and "X"=2'-O-methyl RNA. The top strand is the sense strand, and the bottom strand is the antisense strand. In a further related embodiment, the DsiRNA comprises:

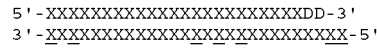

wherein "X"=RNA, "X"=2'-O-methyl RNA, and "D"=DNA. The top strand is the sense strand, and the bottom strand is the antisense strand. This modification pattern is also referred to herein as the "AS-M6" or "M6" modification pattern.
In other embodiments, the DsiRNA comprises:

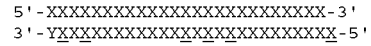

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

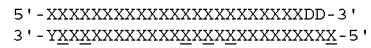

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

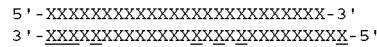

wherein "X"=RNA and "X"=2'-O-methyl RNA. The top strand is the sense strand, and the bottom strand is the antisense strand. In another related embodiment, the DsiRNA comprises:

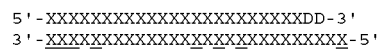

wherein "X"=RNA, "X"=2'-O-methyl RNA, and "D"=DNA. The top strand is the sense strand, and the bottom strand is the antisense strand. This modification pattern is also referred to herein as the "AS-M5" or "M5" modification pattern.

In further embodiments, the DsiRNA comprises:

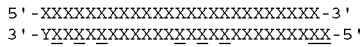

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

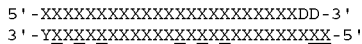

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

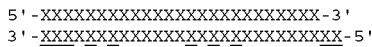

wherein "X"=RNA and "X"=2'-O-methyl RNA. The top strand is the sense strand, and the bottom strand is the antisense strand. In a further related embodiment, the DsiRNA comprises:

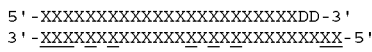

wherein "X"=RNA, "X"=2'-O-methyl RNA, and "D"=DNA. The top strand is the sense strand, and the bottom strand is the antisense strand. This modification pattern is also referred to herein as the "AS-M4" or "M4" modification pattern.

In additional embodiments, the DsiRNA comprises:

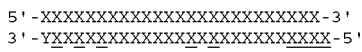

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

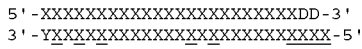

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

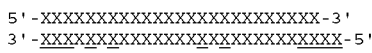

wherein "X"=RNA and "X"=2'-O-methyl RNA. The top strand is the sense strand, and the bottom strand is the antisense strand. In a further related embodiment, the DsiRNA comprises:

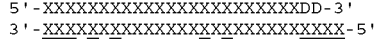

wherein "X"=RNA, "X"=2'-O-methyl RNA, and "D"=DNA. The top strand is the sense strand, and the bottom strand is the antisense strand. This modification pattern is also referred to herein as the "AS-M8" or "M8" modification pattern.

In other embodiments, the DsiRNA comprises:

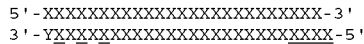

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

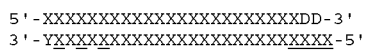

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

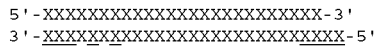

wherein "X"=RNA and "X"=2'-O-methyl RNA. The top strand is the sense strand, and the bottom strand is the antisense strand. In a further related embodiment, the DsiRNA comprises:

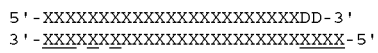

wherein "X"=RNA, "X"=2'-O-methyl RNA, and "D"=DNA. The top strand is the sense strand, and the bottom strand is the antisense strand. This modification pattern is also referred to herein as the "AS-M3" or "M3" modification pattern.

In additional embodiments, the DsiRNA comprises:

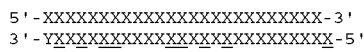

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

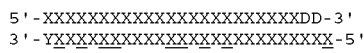

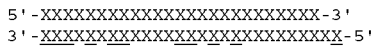

wherein "X"=RNA and "X"=2'-O-methyl RNA. The top strand is the sense strand, and the bottom strand is the antisense strand. In a further related embodiment, the DsiRNA comprises:

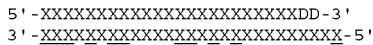

wherein "X"=RNA, "X"=2'-O-methyl RNA, and "D"=DNA. The top strand is the sense strand, and the bottom strand is the antisense strand. This modification pattern is also referred to herein as the "AS-M2" or "M2" modification pattern.

In further embodiments, the DsiRNA comprises:

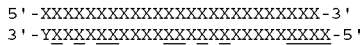

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

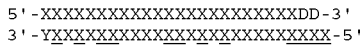

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

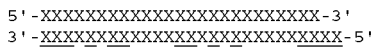

wherein "X"=RNA and "X"=2'-O-methyl RNA. The top strand is the sense strand, and the bottom strand is the antisense strand. In a further related embodiment, the DsiRNA comprises:

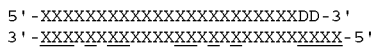

wherein "X"=RNA, "X"=2'-O-methyl RNA, and "D"=DNA. The top strand is the sense strand, and the bottom strand is the antisense strand. This modification pattern is also referred to herein as the "AS-M1" or "M1" modification pattern.

In additional embodiments, the DsiRNA comprises:

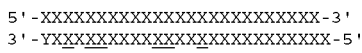

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

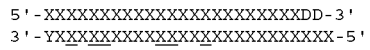

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

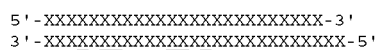

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M9" or "M9" modification pattern.

In other embodiments, the DsiRNA comprises:

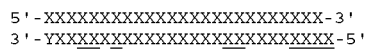

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

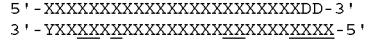

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

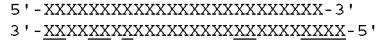

wherein "X"=RNA and "X"=2'-O-methyl RNA. The top strand is the sense strand, and the bottom strand is the antisense strand. In a further related embodiment, the DsiRNA comprises:

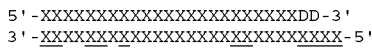

wherein "X"=RNA, "X"=2'-O-methyl RNA, and "D"=DNA. The top strand is the sense strand, and the bottom strand is the antisense strand. This modification pattern is also referred to herein as the "AS-M10" or "M10" modification pattern.

In further embodiments, the DsiRNA comprises:

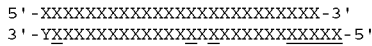

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

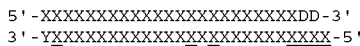

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

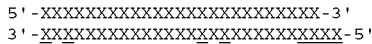

wherein "X"=RNA and "X"=2'-O-methyl RNA. The top strand is the sense strand, and the bottom strand is the antisense strand. In a further related embodiment, the DsiRNA comprises:

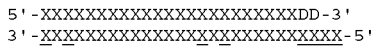

wherein "X"=RNA, "X"=2'-O-methyl RNA, and "D"=DNA. The top strand is the sense strand, and the bottom strand is the antisense strand. This modification pattern is also referred to herein as the "AS-M11" or "M11" modification pattern.

In additional embodiments, the DsiRNA comprises:

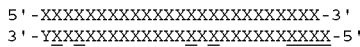

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

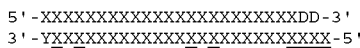

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

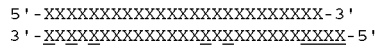

wherein "X"=RNA and "X"=2'-O-methyl RNA. The top strand is the sense strand, and the bottom strand is the antisense strand. In a further related embodiment, the DsiRNA comprises:

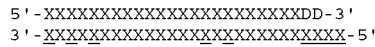

wherein "X"=RNA, "X"=2'-O-methyl RNA, and "D"=DNA. The top strand is the sense strand, and the bottom strand is the antisense strand. This modification pattern is also referred to herein as the "AS-M12" or "M12" modification pattern.

In further embodiments, the DsiRNA comprises:

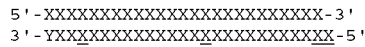

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

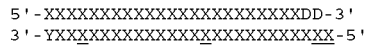

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

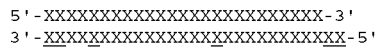

wherein "X"=RNA and "X"=2'-O-methyl RNA. The top strand is the sense strand, and the bottom strand is the antisense strand. In a further related embodiment, the DsiRNA comprises:

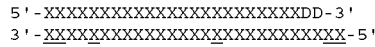

wherein "X"=RNA, "X"=2'-O-methyl RNA, and "D"=DNA. The top strand is the sense strand, and the bottom strand is the antisense strand. This modification pattern is also referred to herein as the "AS-M13" or "M13" modification pattern.

In other embodiments, the DsiRNA comprises:

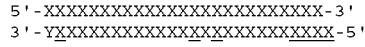

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In another related embodiment, the DsiRNA comprises:

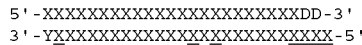

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

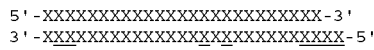

wherein "X"=RNA and "X"=2'-O-methyl RNA. The top strand is the sense strand, and the bottom strand is the antisense strand. In a further related embodiment, the DsiRNA comprises:

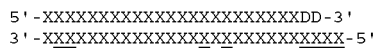

wherein "X"=RNA, "X"=2'-O-methyl RNA, and "D"=DNA. The top strand is the sense strand, and the bottom strand is the antisense strand. This modification pattern is also referred to herein as the "AS-M21" or "M21" modification pattern.

In further embodiments, the DsiRNA comprises:

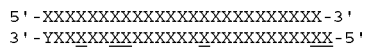

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

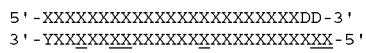

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

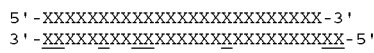

wherein "X"=RNA and "X"=2'-O-methyl RNA. The top strand is the sense strand, and the bottom strand is the antisense strand. In a further related embodiment, the DsiRNA comprises:

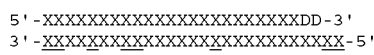

wherein "X"=RNA, "X"=2'-O-methyl RNA, and "D"=DNA. The top strand is the sense strand, and the bottom strand is the antisense strand. This modification pattern is also referred to herein as the "AS-M14" or "M14" modification pattern.

In additional embodiments, the DsiRNA comprises:

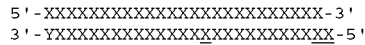

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

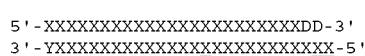

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

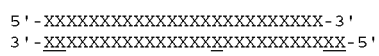

wherein "X"=RNA and "X"=2'-O-methyl RNA. The top strand is the sense strand, and the bottom strand is the antisense strand. In a further related embodiment, the DsiRNA comprises:

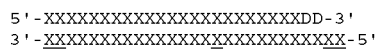

wherein "X"=RNA, "X"=2'-O-methyl RNA, and "D"=DNA. The top strand is the sense strand, and the bottom strand is the antisense strand. This modification pattern is also referred to herein as the "AS-M15" or "M15" modification pattern.

In further embodiments, the DsiRNA comprises:

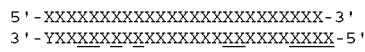

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M16" or "M16" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M17" or "M17" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M18" or "M18" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M19" or "M19" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M20" or "M20" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M22" or "M22" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M24" or "M24" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

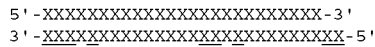

wherein "X"=RNA and "X"=2'-O-methyl RNA. The top strand is the sense strand, and the bottom strand is the antisense strand. In a further related embodiment, the DsiRNA comprises:

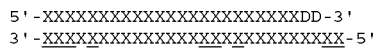

wherein "X"=RNA, "X"=2'-O-methyl RNA, and "D"=DNA. The top strand is the sense strand, and the bottom strand is the antisense strand. This modification pattern is also referred to herein as the "AS-M25" or "M25" modification pattern.

In further embodiments, the DsiRNA comprises:

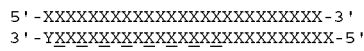

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

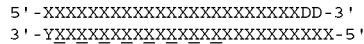

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

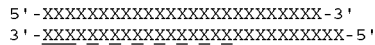

wherein "X"=RNA and "X"=2'-O-methyl RNA. The top strand is the sense strand, and the bottom strand is the antisense strand. In a further related embodiment, the DsiRNA comprises:

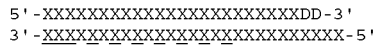

wherein "X"=RNA, "X"=2'-O-methyl RNA, and "D"=DNA. The top strand is the sense strand, and the bottom strand is the antisense strand. This modification pattern is also referred to herein as the "AS-M26" or "M26" modification pattern.

In additional embodiments, the DsiRNA comprises:

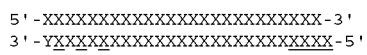

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

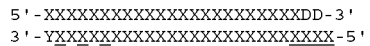

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

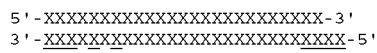

wherein "X"=RNA and "X"=2'-O-methyl RNA. The top strand is the sense strand, and the bottom strand is the antisense strand. In a further related embodiment, the DsiRNA comprises:

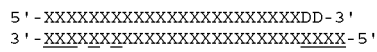

wherein "X"=RNA, "X"=2'-O-methyl RNA, and "D"=DNA. The top strand is the sense strand, and the bottom strand is the antisense strand. This modification pattern is also referred to herein as the "AS-M27" or "M27" modification pattern.

In further embodiments, the DsiRNA comprises:

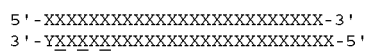

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

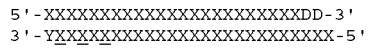

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

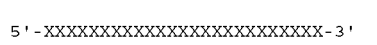

wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M28" or "M28" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M29" or "M29" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M30" or "M30" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M31" or "M31" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M32" or "M32" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M34" or "M34" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M35" or "M35" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M37" or "M37" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M38" or "M38" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

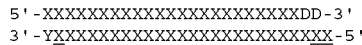

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

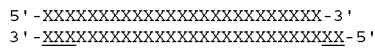

wherein "X"=RNA and "X"=2'-O-methyl RNA. The top strand is the sense strand, and the bottom strand is the antisense strand. In a further related embodiment, the DsiRNA comprises:

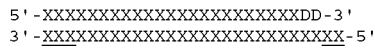

wherein "X"=RNA, "X"=2'-O-methyl RNA, and "D"=DNA. The top strand is the sense strand, and the bottom strand is the antisense strand. This modification pattern is also referred to herein as the "AS-M40" or "M40" modification pattern.

In additional embodiments, the DsiRNA comprises:

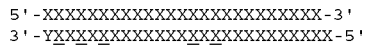

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

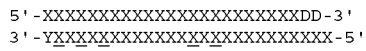

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

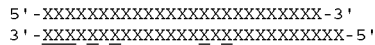

wherein "X"=RNA and "X"=2'-O-methyl RNA. The top strand is the sense strand, and the bottom strand is the antisense strand. In a further related embodiment, the DsiRNA comprises:

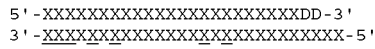

wherein "X"=RNA, "X"=2'-O-methyl RNA, and "D"=DNA. The top strand is the sense strand, and the bottom strand is the antisense strand. This modification pattern is also referred to herein as the "AS-M41" or "M41" modification pattern.

In additional embodiments, the DsiRNA comprises:

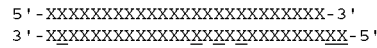

wherein "X"=RNA and "X"=2'-O-methyl RNA. In a further related embodiment, the DsiRNA comprises:

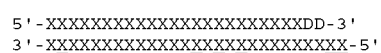

wherein "X"=RNA, "X"=2'-O-methyl RNA, and "D"=DNA. The top strand is the sense strand, and the bottom strand is the antisense strand. This modification pattern is also referred to herein as the "AS-M7*" or "M7*" modification pattern.

In further embodiments, the DsiRNA comprises:

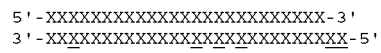

wherein "X"=RNA and "X"=2'-O-methyl RNA. The top strand is the sense strand, and the bottom strand is the antisense strand. In a further related embodiment, the DsiRNA comprises:

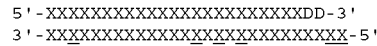

wherein "X"=RNA, "X"=2'-O-methyl RNA, and "D"=DNA. The top strand is the sense strand, and the bottom strand is the antisense strand. This modification pattern is also referred to herein as the "AS-M6*" or "M6*" modification pattern.

In other embodiments, the DsiRNA comprises:

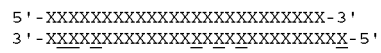

wherein "X"=RNA and "X"=2'-O-methyl RNA. The top strand is the sense strand, and the bottom strand is the antisense strand. In another related embodiment, the DsiRNA comprises:

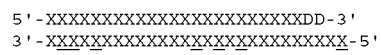

wherein "X"=RNA, "X"=2'-O-methyl RNA, and "D"=DNA. The top strand is the sense strand, and the bottom strand is the antisense strand. This modification pattern is also referred to herein as the "AS-M5*" or "M5*" modification pattern.

In further embodiments, the DsiRNA comprises:

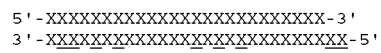

wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M4*" or "M4*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M8*" or "M8*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M2*" or "M2*" modification pattern.

In other embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M10*" or "M10*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M11*" or "M11*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M13*" or "M13*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M14*" or "M14*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M15*" or "M15*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M16*" or "M16*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M17*" or "M17*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M18*" or "M18*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M19*" or "M19*" modification pattern.

In further embodiments, the DsiRNA comprises:

```
5'-XXXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M20*" or "M20*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M22*" or "M22*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M24*" or "M24*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M25*" or "M25*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M26*" or "M26*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M27*" or "M27*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M28*" or "M28*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M29*" or "M29*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M34*" or "M34*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M35*" or "M35*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M37*" or "M37*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M38*" or "M38*" modification pattern.

In further embodiments, the DsiRNA comprises:

```
5'-XXXXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M40*" or "M40*" modification pattern.

In additional embodiments, the DsiRNA comprises:

```
5'-XXXXXXXXXXXXXXXXXXXXXXXXXXX-3'
3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M41*" or "M41*" modification pattern.

In certain embodiments, the sense strand of a DsiRNA of the invention is modified—specific exemplary forms of sense strand modifications are shown below, and it is contemplated that such modified sense strands can be substituted for the sense strand of any of the DsiRNAs shown above to generate a DsiRNA comprising a below-depicted sense strand that anneals with an above-depicted antisense strand. Exemplary sense strand modification patterns include:

```
5'-XXXXXXXXXXXXXXXXXXXXXXXXXDD-3'      "SM1"
5'-XXXXXXXXXXXXXXXXXXXXXXXXXDD-3'      "SM2"
5'-XXXXXXXXXXXXXXXXXXXXXXXXXDD-3'      "SM3"
5'-XXXXXXXXXXXXXXXXXXXXXXXXXDD-3'      "SM4"
5'-XXXXXXXXXXXXXXXXXXXXXXXXXDD-3'      "SM5"
5'-XXXXXXXXXXXXXXXXXXXXXXXXXDD-3'      "SM6"
5'-XXXXXXXXXXXXXXXXXXXXXXXXXDD-3'      "SM7"
5'-XXXXXXXXXXXXXXXXXXXXXXXXXDD-3'      "SM8"
5'-XXXXXXXXXXXXXXXXXXXXXXXXXDD-3'      "SM9"
5'-XXXXXXXXXXXXXXXXXXXXXXXXXDD-3'      "SM10"
5'-XXXXXXXXXXXXXXXXXXXXXXXXXDD-3'      "SM11"
5'-XXXXXXXXXXXXXXXXXXXXXXXXXDD-3'      "SM12"
5'-XXXXXXXXXXXXXXXXXXXXXXXXXDD-3'      "SM13"
5'-XXXXXXXXXXXXXXXXXXXXXXXXXDD-3'      "SM14"
5'-XXXXXXXXXXXXXXXXXXXXXXXXXDD-3'      "SM15"
5'-XXXXXXXXXXXXXXXXXXXXXXXXXDD-3'      "SM16"
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
``` where "X"=RNA, "X"=2'-O-methyl RNA, and "D"=DNA.

The above modification patterns can also be incorporated into, e.g., the extended DsiRNA structures and mismatch and/or frayed DsiRNA structures described below.

In another embodiment, the DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary 27mer DsiRNA agent with two terminal mismatched residues is shown:

$$5'-XXXXXXXXXXXXXXXXXXXXXXXXXXX^M M-3'$$
$$3'-XXXXXXXXXXXXXXXXXXXXXXXXXXX_M M-5'$$

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand is the sense strand, and the bottom strand is the antisense strand. Alternatively, the bottom strand is the sense strand and the top strand is the antisense strand.

In certain additional embodiments, the present invention provides compositions for RNA interference (RNAi) that possess one or more base paired deoxyribonucleotides within a region of a double stranded ribonucleic acid (dsRNA) that is positioned 3' of a projected sense strand Dicer cleavage site and correspondingly 5' of a projected antisense strand Dicer cleavage site. The compositions of the invention comprise a dsRNA which is a precursor molecule, i.e., the dsRNA of the present invention is processed in vivo to produce an active small interfering nucleic acid (siRNA). The dsRNA is processed by Dicer to an active siRNA which is incorporated into RISC.

In certain embodiments, the DsiRNA agents of the invention can have the following exemplary structures (noting that any of the following exemplary structures can be combined, e.g., with the bottom strand modification patterns of the above-described structures—in one specific example, the bottom strand modification pattern shown in any of the above structures is applied to the 27 most 3' residues of the bottom strand of any of the following structures; in another specific example, the bottom strand modification pattern shown in any of the above structures upon the 23 most 3' residues of the bottom strand is applied to the 23 most 3' residues of the bottom strand of any of the following structures):

In one such embodiment, the DsiRNA comprises the following (an exemplary "right-extended", "DNA extended" DsiRNA):

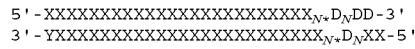

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

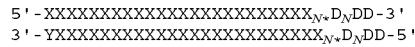

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

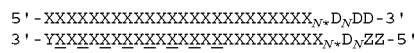

wherein "X"=RNA, "$\underline{X}$"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

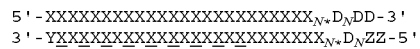

wherein "X"=RNA, "$\underline{X}$"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

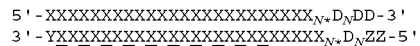

wherein "X"=RNA, "$\underline{X}$"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

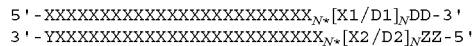

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In the structures depicted herein, the 5' end of either the sense strand or antisense strand can optionally comprise a phosphate group.

In another embodiment, a DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

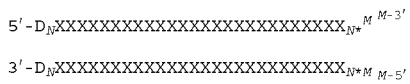

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-15 or, optionally, 1-8. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In one embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. An exemplary structure for such a molecule is shown:

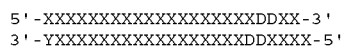

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the anti-sense strand. The above structure is modeled to force Dicer to cleave a minimum of a 21mer duplex as its primary post-processing form. In embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In one embodiment, the DsiRNA comprises the following (an exemplary "left-extended", "DNA extended" DsiRNA):

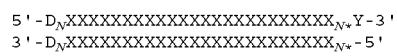

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

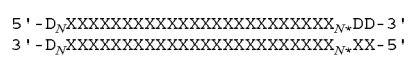

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

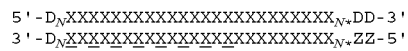

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

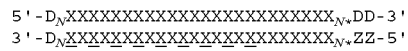

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

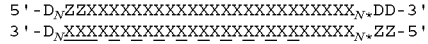

wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

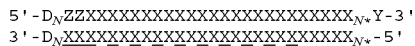

wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

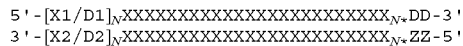

wherein "X"=RNA, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In a related embodiment, the DsiRNA comprises:

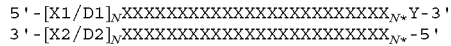

wherein "X"=RNA, "D"=DNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

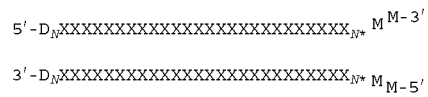

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-8 or 1-10. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In another embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. Exemplary structures for such a molecule are shown:

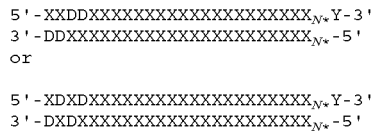

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In any of the above embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In certain embodiments, the "D" residues of the above structures include at least one PS-DNA or PS-RNA. Optionally, the "D" residues of the above structures include at least one modified nucleotide that inhibits Dicer cleavage.

While the above-described "DNA-extended" DsiRNA agents can be categorized as either "left extended" or "right extended", DsiRNA agents comprising both left- and right-extended DNA-containing sequences within a single agent (e.g., both flanks surrounding a core dsRNA structure are dsDNA extensions) can also be generated and used in similar manner to those described herein for "right-extended" and "left-extended" agents.

In some embodiments, the DsiRNA of the instant invention further comprises a linking moiety or domain that joins the sense and antisense strands of a DNA:DNA-extended DsiRNA agent. Optionally, such a linking moiety domain joins the 3' end of the sense strand and the 5' end of the antisense strand. The linking moiety may be a chemical (non-nucleotide) linker, such as an oligomethylenediol linker, oligoethylene glycol linker, or other art-recognized linker moiety. Alternatively, the linker can be a nucleotide linker, optionally including an extended loop and/or tetraloop.

In one embodiment, the DsiRNA agent has an asymmetric structure, with the sense strand having a 25-base pair length, and the antisense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxynucleotides at the 3' end of the sense strand.

In another embodiment, the DsiRNA agent has an asymmetric structure, with the antisense strand having a 25-base pair length, and the sense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxyribonucleotides at the 3' end of the antisense strand.

Exemplary HIF-1α targeting DsiRNA agents of the invention, and their associated HIF-1α target sequences, include the following, presented in the below series of tables:
Table Number:
(2) Selected Anti-HIF-1α DsiRNA Agents (Asymmetrics, HIF-1α);
(3) Selected Anti-HIF-1α DsiRNAs, Unmodified Duplexes (Asymmetrics, HIF-1α Variant 1);
(4) Selected Mouse Anti-HIF-1α DsiRNAs (Asymmetrics);
(5) DsiRNA Target Sequences (21mers) In HIF-1α;
(6) Selected Human Anti-HIF-1α "Blunt/Fray" DsiRNAs (HIF-1α Variant 1);
(7) Selected Human Anti-HIF-1α "Blunt/Blunt" DsiRNAs (HIF-1α Variant 1);

TABLE 2

Selected Anti-HIF-1α DsiRNA Agents (Asymmetrics, HIF-1α)

|   |   |   |
|---|---|---|
|   | 5'-GCGCGCCCGAGCGCGCCUCCGCCct-3' | (SEQ ID NO: 379) |
|   | 3'-GGCGCGCGGGCUCGCGCGGAGGCGGGA-5' | (SEQ ID NO: 1) |
| HIF-1α-81 Target: | 5'-CCGCGCGCCCGAGCGCGCCTCCGCCCT-3' | (SEQ ID NO: 757) |
|   | 5'-GCGCCCGAGCGCGCCUCCGCCCUtg-3' | (SEQ ID NO: 380) |
|   | 3'-CGCGCGGGCUCGCGCGGAGGCGGGAAC-5' | (SEQ ID NO: 2) |
| HIF-1α-83 Target: | 5'-GCGCGCCCGAGCGCGCCTCCGCCCTTG-3' | (SEQ ID NO: 758) |
|   | 5'-GCCCGAGCGCGCCUCCGCCCUUGcc-3' | (SEQ ID NO: 381) |
|   | 3'-CGCGGGCUCGCGCGGAGGCGGGAACGG-5' | (SEQ ID NO: 3) |
| HIF-1α-85 Target: | 5'-GCGCCCGAGCGCGCCTCCGCCCTTGCC-3' | (SEQ ID NO: 759) |
|   | 5'-CCGAGCGCGCCUCCGCCCUUGCCcg-3' | (SEQ ID NO: 382) |
|   | 3'-CGGGCUCGCGCGGAGGCGGGAACGGGC-5' | (SEQ ID NO: 4) |
| HIF-1α-87 Target: | 5'-GCCCGAGCGCGCCTCCGCCCTTGCCCG-3' | (SEQ ID NO: 760) |
|   | 5'-GAGCGCGCCUCCGCCCUUGCCCGcc-3' | (SEQ ID NO: 383) |
|   | 3'-GGCUCGCGCGGAGGCGGGAACGGGCGG-5' | (SEQ ID NO: 5) |
| HIF-1α-89 Target: | 5'-CCGAGCGCGCCTCCGCCCTTGCCCGCC-3' | (SEQ ID NO: 761) |
|   | 5'-UGCCUCAGCUCCUCAGUGCACAGtg-3' | (SEQ ID NO: 384) |
|   | 3'-CGACGGAGUCGAGGAGUCACGUGUCAC-5' | (SEQ ID NO: 6) |
| HIF-1α-123 Target: | 5'-GCTGCCTCAGCTCCTCAGTGCACAGTG-3' | (SEQ ID NO: 762) |
|   | 5'-GCCUCAGCUCCUCAGUGCACAGUgc-3' | (SEQ ID NO: 385) |
|   | 3'-GACGGAGUCGAGGAGUCACGUGUCACG-5' | (SEQ ID NO: 7) |
| HIF-1α-124 Target: | 5'-CTGCCTCAGCTCCTCAGTGCACAGTGC-3' | (SEQ ID NO: 763) |
|   | 5'-CUCAGCUCCUCAGUGCACAGUGCtg-3' | (SEQ ID NO: 386) |
|   | 3'-CGGAGUCGAGGAGUCACGUGUCACGAC-5' | (SEQ ID NO: 8) |

TABLE 2-continued

Selected Anti-HIF-1α DsiRNA Agents (Asymmetrics, HIF-1α)

```
HIF-1α-126 Target:   5'-GCCTCAGCTCCTCAGTGCACAGTGCTG-3'     (SEQ ID NO: 764)

5'-GCUCCUCAGUGCACAGUGCUGCCtc-3'       (SEQ ID NO: 387)
                     3'-GUCGAGGAGUCACGUGUCACGACGGAG-5'     (SEQ ID NO: 9)

HIF-1α-130 Target:   5'-CAGCTCCTCAGTGCACAGTGCTGCCTC-3'     (SEQ ID NO: 765)

5'-CUCCUCAGUGCACAGUGCUGCCUcg-3'       (SEQ ID NO: 388)
                     3'-UCGAGGAGUCACGUGUCACGACGGAGC-5'     (SEQ ID NO: 10)

HIF-1α-131 Target:   5'-AGCTCCTCAGTGCACAGTGCTGCCTCG-3'     (SEQ ID NO: 766)

5'-GCUGCCUCGUCUGAGGGGACAGGag-3'       (SEQ ID NO: 389)
                     3'-CACGACGGAGCAGACUCCCCUGUCCUC-5'     (SEQ ID NO: 11)

HIF-1α-147 Target:   5'-GTGCTGCCTCGTCTGAGGGGACAGGAG-3'     (SEQ ID NO: 767)

5'-UUGCCGCCCGCUUCUCUCUAGUCtc-3'       (SEQ ID NO: 390)
                     3'-CUAACGGCGGGCGAAGAGAGAUCAGAG-5'     (SEQ ID NO: 12)

HIF-1α-265 Target:   5'-GATTGCCGCCCGCTTCTCTCTAGTCTC-3'     (SEQ ID NO: 768)

5'-GCCGCCCGCUUCUCUCUAGUCUCac-3'       (SEQ ID NO: 391)
                     3'-AACGGCGGGCGAAGAGAGAUCAGAGUG-5'     (SEQ ID NO: 13)

HIF-1α-267 Target:   5'-TTGCCGCCCGCTTCTCTCTAGTCTCAC-3'     (SEQ ID NO: 769)

5'-CCGCCCGCUUCUCUCUAGUCUCAcg-3'       (SEQ ID NO: 392)
                     3'-ACGGCGGGCGAAGAGAGAUCAGAGUGC-5'     (SEQ ID NO: 14)

HIF-1α-268 Target:   5'-TGCCGCCCGCTTCTCTCTAGTCTCACG-3'     (SEQ ID NO: 770)

5'-GAGGGGUUUCCCGCCUCGCACCCcc-3'       (SEQ ID NO: 393)
                     3'-UGCUCCCCAAAGGGCGGAGCGUGGGGG-5'     (SEQ ID NO: 15)

HIF-1α-292 Target:   5'-ACGAGGGGTTTCCCGCCTCGCACCCCC-3'     (SEQ ID NO: 771)

5'-CUCUGGACUUGCCUUUCCUUCUCtt-3'       (SEQ ID NO: 394)
                     3'-UGGAGACCUGAACGGAAAGGAAGAGAA-5'     (SEQ ID NO: 16)

HIF-1α-319 Target:   5'-ACCTCTGGACTTGCCTTTCCTTCTCTT-3'     (SEQ ID NO: 772)

5'-UGGACUUGCCUUUCCUUCUCUUCtc-3'       (SEQ ID NO: 395)
                     3'-AGACCUGAACGGAAAGGAAGAGAAGAG-5'     (SEQ ID NO: 17)

HIF-1α-322 Target:   5'-TCTGGACTTGCCTTTCCTTCTCTTCTC-3'     (SEQ ID NO: 773)

5'-GACUUGCCUUUCCUUCUCUUCUCcg-3'       (SEQ ID NO: 396)
                     3'-ACCUGAACGGAAAGGAAGAGAAGAGGC-5'     (SEQ ID NO: 18)

HIF-1α-324 Target:   5'-TGGACTTGCCTTTCCTTCTCTTCTCCG-3'     (SEQ ID NO: 774)

5'-UUGCCUUUCCUUCUCUUCUCCGCgt-3'       (SEQ ID NO: 397)
                     3'-UGAACGGAAAGGAAGAGAAGAGGCGCA-5'     (SEQ ID NO: 19)

HIF-1α-327 Target:   5'-ACTTGCCTTTCCTTCTCTTCTCCGCGT-3'     (SEQ ID NO: 775)

5'-GCCUUUCCUUCUCUUCUCCGCGUgt-3'       (SEQ ID NO: 398)
                     3'-AACGGAAAGGAAGAGAAGAGGCGCACA-5'     (SEQ ID NO: 20)

HIF-1α-329 Target:   5'-TTGCCTTTCCTTCTCTTCTCCGCGTGT-3'     (SEQ ID NO: 776)

5'-CCUUUCCUUCUCUUCUCCGCGUGtg-3'       (SEQ ID NO: 399)
                     3'-ACGGAAAGGAAGAGAAGAGGCGCACAC-5'     (SEQ ID NO: 21)

HIF-1α-330 Target:   5'-TGCCTTTCCTTCTCTTCTCCGCGTGTG-3'     (SEQ ID NO: 777)

5'-CUUUCCUUCUCUUCUCCGCGUGUgg-3'       (SEQ ID NO: 400)
                     3'-CGGAAAGGAAGAGAAGAGGCGCACACC-5'     (SEQ ID NO: 22)

HIF-1α-331 Target:   5'-GCCTTTCCTTCTCTTCTCCGCGTGTGG-3'     (SEQ ID NO: 778)

5'-UUCUCCGCGUGUGGAGGGAGCCAgc-3'       (SEQ ID NO: 401)
                     3'-AGAAGAGGCGCACACCUCCCUCGGUCG-5'     (SEQ ID NO: 23)
```

TABLE 2-continued

Selected Anti-HIF-1α DsiRNA Agents (Asymmetrics, HIF-1α)

```
HIF-1α-342 Target:   5'-TCTTCTCCGCGTGTGGAGGGAGCCAGC-3'      (SEQ ID NO: 779)

5'-CUCCGCGUGUGGAGGGAGCCAGCgc-3'        (SEQ ID NO: 402)
                     3'-AAGAGGCGCACACCUCCCUCGGUCGCG-5'      (SEQ ID NO: 24)

HIF-1α-344 Target:   5'-TTCTCCGCGTGTGGAGGGAGCCAGCGC-3'      (SEQ ID NO: 780)

5'-CCGCGUGUGGAGGGAGCCAGCGCtt-3'        (SEQ ID NO: 403)
                     3'-GAGGCGCACACCUCCCUCGGUCGCGAA-5'      (SEQ ID NO: 25)

HIF-1α-346 Target:   5'-CTCCGCGTGTGGAGGGAGCCAGCGCTT-3'      (SEQ ID NO: 781)

5'-GAGCCAGCGCUUAGGCCGGAGCGag-3'        (SEQ ID NO: 404)
                     3'-CCCUCGGUCGCGAAUCCGGCCUCGCUC-5'      (SEQ ID NO: 26)

HIF-1α-359 Target:   5'-GGGAGCCAGCGCTTAGGCCGGAGCGAG-3'      (SEQ ID NO: 782)

5'-GAAGACAUCGCGGGGACCGAUUCac-3'        (SEQ ID NO: 405)
                     3'-CACUUCUGUAGCGCCCCUGGCUAAGUG-5'      (SEQ ID NO: 27)

HIF-1α-403 Target:   5'-GTGAAGACATCGCGGGGACCGATTCAC-3'      (SEQ ID NO: 783)

5'-AUUCACCAUGGAGGGCGCCGGCGgc-3'        (SEQ ID NO: 406)
                     3'-GCUAAGUGGUACCUCCCGCGGCCGCCG-5'      (SEQ ID NO: 28)

HIF-1α-422 Target:   5'-CGATTCACCATGGAGGGCGCCGGCGGC-3'      (SEQ ID NO: 784)

5'-CCAUGGAGGGCGCCGGCGGCGCGaa-3'        (SEQ ID NO: 407)
                     3'-GUGGUACCUCCCGCGGCCGCCGCGCUU-5'      (SEQ ID NO: 29)

HIF-1α-427 Target:   5'-CACCATGGAGGGCGCCGGCGGCGCGAA-3'      (SEQ ID NO: 785)

5'-AUGGAGGGCGCCGGCGGCGCGAAcg-3'        (SEQ ID NO: 408)
                     3'-GGUACCUCCCGCGGCCGCCGCGCUUGC-5'      (SEQ ID NO: 30)

HIF-1α-429 Target:   5'-CCATGGAGGGCGCCGGCGGCGCGAACG-3'      (SEQ ID NO: 786)

5'-CGAACGACAAGAAAAAGAUAAGUtc-3'        (SEQ ID NO: 409)
                     3'-GCGCUUGCUGUUCUUUUUCUAUUCAAG-5'      (SEQ ID NO: 31)

HIF-1α-448 Target:   5'-CGCGAACGACAAGAAAAAGATAAGTTC-3'      (SEQ ID NO: 787)

5'-CAAGAAAAAGAUAAGUUCUGAACgt-3'        (SEQ ID NO: 410)
                     3'-CUGUUCUUUUUCUAUUCAAGACUUGCA-5'      (SEQ ID NO: 32)

HIF-1α-455 Target:   5'-GACAAGAAAAAGATAAGTTCTGAACGT-3'      (SEQ ID NO: 788)

5'-GUUCUGAACGUCGAAAAGAAAAGtc-3'        (SEQ ID NO: 411)
                     3'-UUCAAGACUUGCAGCUUUUCUUUUCAG-5'      (SEQ ID NO: 33)

HIF-1α-469 Target:   5'-AAGTTCTGAACGTCGAAAAGAAAAGTC-3'      (SEQ ID NO: 789)

5'-UCUGAACGUCGAAAAGAAAAGUCtc-3'        (SEQ ID NO: 412)
                     3'-CAAGACUUGCAGCUUUUCUUUUCAGAG-5'      (SEQ ID NO: 34)

HIF-1α-471 Target:   5'-GTTCTGAACGTCGAAAAGAAAAGTCTC-3'      (SEQ ID NO: 790)

5'-UGAACGUCGAAAAGAAAAGUCUCga-3'        (SEQ ID NO: 413)
                     3'-AGACUUGCAGCUUUUCUUUUCAGAGCU-5'      (SEQ ID NO: 35)

HIF-1α-473 Target:   5'-TCTGAACGTCGAAAAGAAAAGTCTCGA-3'      (SEQ ID NO: 791)

5'-AACGUCGAAAAGAAAAGUCUCGAga-3'        (SEQ ID NO: 414)
                     3'-ACUUGCAGCUUUUCUUUUCAGAGCUCU-5'      (SEQ ID NO: 36)

HIF-1α-475 Target:   5'-TGAACGTCGAAAAGAAAAGTCTCGAGA-3'      (SEQ ID NO: 792)

5'-GAAUCUGAAGUUUUUAUGAGCUg-3'          (SEQ ID NO: 415)
                     3'-UUCUUAGACUUCAAAAAAUACUCGAAC-5'      (SEQ ID NO: 37)

HIF-1α-525 Target:   5'-AAGAATCTGAAGTTTTTATGAGCTTG-3'       (SEQ ID NO: 793)

5'-UCUGAAGUUUUUAUGAGCUUGCtc-3'         (SEQ ID NO: 416)
                     3'-UUAGACUUCAAAAAAUACUCGAACGAG-5'      (SEQ ID NO: 38)
```

TABLE 2-continued

Selected Anti-HIF-1α DsiRNA Agents (Asymmetrics, HIF-1α)

```
HIF-1α-528 Target:   5'-AATCTGAAGTTTTTTATGAGCTTGCTC-3'      (SEQ ID NO: 794)

5'-UGAAGUUUUUAUGAGCUUGCUCat-3'         (SEQ ID NO: 417)
                     3'-AGACUUCAAAAAAUACUCGAACGAGUA-5'      (SEQ ID NO: 39)

HIF-1α-530 Target:   5'-TCTGAAGTTTTTTATGAGCTTGCTCAT-3'      (SEQ ID NO: 795)

5'-AAGUUUUUAUGAGCUUGCUCAUca-3'         (SEQ ID NO: 418)
                     3'-ACUUCAAAAAAUACUCGAACGAGUAGU-5'      (SEQ ID NO: 40)

HIF-1α-532 Target:   5'-TGAAGTTTTTTATGAGCTTGCTCATCA-3'      (SEQ ID NO: 796)

5'-GUUUUUAUGAGCUUGCUCAUCAgt-3'         (SEQ ID NO: 419)
                     3'-UUCAAAAAAUACUCGAACGAGUAGUCA-5'      (SEQ ID NO: 41)

HIF-1α-534 Target:   5'-AAGTTTTTTATGAGCTTGCTCATCAGT-3'      (SEQ ID NO: 797)

5'-UUUUUAUGAGCUUGCUCAUCAGUtg-3'        (SEQ ID NO: 420)
                     3'-CAAAAAAUACUCGAACGAGUAGUCAAC-5'      (SEQ ID NO: 42)

HIF-1α-536 Target:   5'-GTTTTTTATGAGCTTGCTCATCAGTTG-3'      (SEQ ID NO: 798)

5'-UUUAUGAGCUUGCUCAUCAGUUGcc-3'        (SEQ ID NO: 421)
                     3'-AAAAAUACUCGAACGAGUAGUCAACGG-5'      (SEQ ID NO: 43)

HIF-1α-538 Target:   5'-TTTTTATGAGCTTGCTCATCAGTTGCC-3'      (SEQ ID NO: 799)

5'-UAUGAGCUUGCUCAUCAGUUGCCac-3'        (SEQ ID NO: 422)
                     3'-AAAUACUCGAACGAGUAGUCAACGGUG-5'      (SEQ ID NO: 44)

HIF-1α-540 Target:   5'-TTTATGAGCTTGCTCATCAGTTGCCAC-3'      (SEQ ID NO: 800)

5'-UGAGCUUGCUCAUCAGUUGCCACtt-3'        (SEQ ID NO: 423)
                     3'-AUACUCGAACGAGUAGUCAACGGUGAA-5'      (SEQ ID NO: 45)

HIF-1α-542 Target:   5'-TATGAGCTTGCTCATCAGTTGCCACTT-3'      (SEQ ID NO: 801)

5'-AGCUUGCUCAUCAGUUGCCACUUcc-3'        (SEQ ID NO: 424)
                     3'-ACUCGAACGAGUAGUCAACGGUGAAGG-5'      (SEQ ID NO: 46)

HIF-1α-544 Target:   5'-TGAGCTTGCTCATCAGTTGCCACTTCC-3'      (SEQ ID NO: 802)

5'-CUUGCUCAUCAGUUGCCACUUCCac-3'        (SEQ ID NO: 425)
                     3'-UCGAACGAGUAGUCAACGGUGAAGGUG-5'      (SEQ ID NO: 47)

HIF-1α-546 Target:   5'-AGCTTGCTCATCAGTTGCCACTTCCAC-3'      (SEQ ID NO: 803)

5'-UGCUCAUCAGUUGCCACUUCCACat-3'        (SEQ ID NO: 426)
                     3'-GAACGAGUAGUCAACGGUGAAGGUGUA-5'      (SEQ ID NO: 48)

HIF-1α-548 Target:   5'-CTTGCTCATCAGTTGCCACTTCCACAT-3'      (SEQ ID NO: 804)

5'-CUCAUCAGUUGCCACUUCCACAUaa-3'        (SEQ ID NO: 427)
                     3'-ACGAGUAGUCAACGGUGAAGGUGUAUU-5'      (SEQ ID NO: 49)

HIF-1α-550 Target:   5'-TGCTCATCAGTTGCCACTTCCACATAA-3'      (SEQ ID NO: 805)

5'-CACUUCCACAUAAUGUGAGUUCGca-3'        (SEQ ID NO: 428)
                     3'-CGGUGAAGGUGUAUUACACUCAAGCGU-5'      (SEQ ID NO: 50)

HIF-1α-562 Target:   5'-GCCACTTCCACATAATGTGAGTTCGCA-3'      (SEQ ID NO: 806)

5'-CUUCUGGAUGCUGGUGAUUUGGAta-3'        (SEQ ID NO: 429)
                     3'-UUGAAGACCUACGACCACUAAACCUAU-5'      (SEQ ID NO: 51)

HIF-1α-642 Target:   5'-AACTTCTGGATGCTGGTGATTTGGATA-3'      (SEQ ID NO: 807)

5'-UCUGGAUGCUGGUGAUUUGGAUAtt-3'        (SEQ ID NO: 430)
                     3'-GAAGACCUACGACCACUAAACCUAUAA-5'      (SEQ ID NO: 52)

HIF-1α-644 Target:   5'-CTTCTGGATGCTGGTGATTTGGATATT-3'      (SEQ ID NO: 808)

5'-CUGGAUGCUGGUGAUUUGGAUAUtg-3'        (SEQ ID NO: 431)
                     3'-AAGACCUACGACCACUAAACCUAUAAC-5'      (SEQ ID NO: 53)
```

TABLE 2-continued

Selected Anti-HIF-1α DsiRNA Agents (Asymmetrics, HIF-1α)

| | | |
|---|---|---|
| HIF-1α-645 Target: | 5'-TTCTGGATGCTGGTGATTTGGATATTG-3' | (SEQ ID NO: 809) |
| | 5'-UAUUGAAGAUGACAUGAAAGCACag-3' | (SEQ ID NO: 432) |
| | 3'-<u>CUA</u>UAACUUCUACUGUACUUUCGUGUC-5' | (SEQ ID NO: 54) |
| HIF-1α-665 Target: | 5'-GATATTGAAGATGACATGAAAGCACAG-3' | (SEQ ID NO: 810) |
| | 5'-UGAAUUGCUUUUAUUUGAAAGCCtt-3' | (SEQ ID NO: 433) |
| | 3'-<u>CUA</u>CUUAACGAAAAUAAACUUUCGGAA-5' | (SEQ ID NO: 55) |
| HIF-1α-691 Target: | 5'-GATGAATTGCTTTTATTTGAAAGCCTT-3' | (SEQ ID NO: 811) |
| | 5'-GAAAGCCUUGGAUGGUUUUGUUAtg-3' | (SEQ ID NO: 434) |
| | 3'-<u>AAC</u>UUUCGGAACCUACCAAAACAAUAC-5' | (SEQ ID NO: 56) |
| HIF-1α-707 Target: | 5'-TTGAAAGCCTTGGATGGTTTTGTTATG-3' | (SEQ ID NO: 812) |
| | 5'-GCCUUGGAUGGUUUUGUUAUGGUtc-3' | (SEQ ID NO: 435) |
| | 3'-<u>UUC</u>GGAACCUACCAAAACAAUACCAAG-5' | (SEQ ID NO: 57) |
| HIF-1α-711 Target: | 5'-AAGCCTTGGATGGTTTTGTTATGGTTC-3' | (SEQ ID NO: 813) |
| | 5'-CUUGGAUGGUUUUGUUAUGGUUCtc-3' | (SEQ ID NO: 436) |
| | 3'-<u>CGG</u>AACCUACCAAAACAAUACCAAGAG-5' | (SEQ ID NO: 58) |
| HIF-1α-713 Target: | 5'-GCCTTGGATGGTTTTGTTATGGTTCTC-3' | (SEQ ID NO: 814) |
| | 5'-UGGAUGGUUUUGUUAUGGUUCUCac-3' | (SEQ ID NO: 437) |
| | 3'-<u>GAA</u>CCUACCAAAACAAUACCAAGAGUG-5' | (SEQ ID NO: 59) |
| HIF-1α-715 Target: | 5'-CTTGGATGGTTTTGTTATGGTTCTCAC-3' | (SEQ ID NO: 815) |
| | 5'-GAUGGUUUUGUUAUGGUUCUCACag-3' | (SEQ ID NO: 438) |
| | 3'-<u>ACC</u>UACCAAAACAAUACCAAGAGUGUC-5' | (SEQ ID NO: 60) |
| HIF-1α-717 Target: | 5'-TGGATGGTTTTGTTATGGTTCTCACAG-3' | (SEQ ID NO: 816) |
| | 5'-AUUUACAUUUCUGAUAAUGUGAAca-3' | (SEQ ID NO: 439) |
| | 3'-<u>ACU</u>AAAUGUAAAGACUAUUACACUUGU-5' | (SEQ ID NO: 61) |
| HIF-1α-756 Target: | 5'-TGATTTACATTTCTGATAATGTGAACA-3' | (SEQ ID NO: 817) |
| | 5'-GAUUAACUCAGUUUGAACUAACUgg-3' | (SEQ ID NO: 440) |
| | 3'-<u>CCC</u>UAAUUGAGUCAAACUUGAUUGACC-5' | (SEQ ID NO: 62) |
| HIF-1α-790 Target: | 5'-GGGATTAACTCAGTTTGAACTAACTGG-3' | (SEQ ID NO: 818) |
| | 5'-UAACUCAGUUUGAACUAACUGGAca-3' | (SEQ ID NO: 441) |
| | 3'-<u>UAA</u>UUGAGUCAAACUUGAUUGACCUGU-5' | (SEQ ID NO: 63) |
| HIF-1α-793 Target: | 5'-ATTAACTCAGTTTGAACTAACTGGACA-3' | (SEQ ID NO: 819) |
| | 5'-GUUUGAUUUUACUCAUCCAUGUGac-3' | (SEQ ID NO: 442) |
| | 3'-<u>CAC</u>AAACUAAAAUGAGUAGGUACACUG-5' | (SEQ ID NO: 64) |
| HIF-1α-824 Target: | 5'-GTGTTTGATTTTACTCATCCATGTGAC-3' | (SEQ ID NO: 820) |
| | 5'-UUGAUUUUACUCAUCCAUGUGACca-3' | (SEQ ID NO: 443) |
| | 3'-<u>CAA</u>ACUAAAAUGAGUAGGUACACUGGU-5' | (SEQ ID NO: 65) |
| HIF-1α-826 Target: | 5'-GTTTGATTTTACTCATCCATGTGACCA-3' | (SEQ ID NO: 821) |
| | 5'-GAUUUUACUCAUCCAUGUGACCAtg-3' | (SEQ ID NO: 444) |
| | 3'-<u>AAC</u>UAAAAUGAGUAGGUACACUGGUAC-5' | (SEQ ID NO: 66) |
| HIF-1α-828 Target: | 5'-TTGATTTTACTCATCCATGTGACCATG-3' | (SEQ ID NO: 822) |
| | 5'-UUUUACUCAUCCAUGUGACCAUGag-3' | (SEQ ID NO: 445) |
| | 3'-<u>CUA</u>AAAUGAGUAGGUACACUGGUACUC-5' | (SEQ ID NO: 67) |
| HIF-1α-830 Target: | 5'-GATTTTACTCATCCATGTGACCATGAG-3' | (SEQ ID NO: 823) |
| | 5'-UUACUCAUCCAUGUGACCAUGAGga-3' | (SEQ ID NO: 446) |
| | 3'-<u>AAA</u>AUGAGUAGGUACACUGGUACUCCU-5' | (SEQ ID NO: 68) |

TABLE 2-continued

Selected Anti-HIF-1α DsiRNA Agents (Asymmetrics, HIF-1α)

```
HIF-1α-832 Target:    5'-TTTTACTCATCCATGTGACCATGAGGA-3'      (SEQ ID NO: 824)

5'-ACUCAUCCAUGUGACCAUGAGGAaa-3'         (SEQ ID NO: 447)
                      3'-AAUGAGUAGGUACACUGGUACUCCUUU-5'       (SEQ ID NO: 69)

HIF-1α-834 Target:    5'-TTACTCATCCATGTGACCATGAGGAAA-3'       (SEQ ID NO: 825)

5'-UCAUCCAUGUGACCAUGAGGAAAtg-3'         (SEQ ID NO: 448)
                      3'-UGAGUAGGUACACUGGUACUCCUUUAC-5'       (SEQ ID NO: 70)

HIF-1α-836 Target:    5'-ACTCATCCATGTGACCATGAGGAAATG-3'       (SEQ ID NO: 826)

5'-AUCCAUGUGACCAUGAGGAAAUGag-3'         (SEQ ID NO: 449)
                      3'-AGUAGGUACACUGGUACUCCUUUACUC-5'       (SEQ ID NO: 71)

HIF-1α-838 Target:    5'-TCATCCATGTGACCATGAGGAAATGAG-3'       (SEQ ID NO: 827)

5'-CCAUGUGACCAUGAGGAAAUGAGag-3'         (SEQ ID NO: 450)
                      3'-UAGGUACACUGGUACUCCUUUACUCUC-5'       (SEQ ID NO: 72)

HIF-1α-840 Target:    5'-ATCCATGTGACCATGAGGAAATGAGAG-3'       (SEQ ID NO: 828)

5'-AUGUGACCAUGAGGAAAUGAGAGaa-3'         (SEQ ID NO: 451)
                      3'-GGUACACUGGUACUCCUUUACUCUCUU-5'       (SEQ ID NO: 73)

HIF-1α-842 Target:    5'-CCATGTGACCATGAGGAAATGAGAGAA-3'       (SEQ ID NO: 829)

5'-GUGACCAUGAGGAAAUGAGAGAAat-3'         (SEQ ID NO: 452)
                      3'-UACACUGGUACUCCUUUACUCUCUUUA-5'       (SEQ ID NO: 74)

HIF-1α-844 Target:    5'-ATGTGACCATGAGGAAATGAGAGAAAT-3'       (SEQ ID NO: 830)

5'-GACCAUGAGGAAAUGAGAGAAAUgc-3'         (SEQ ID NO: 453)
                      3'-CACUGGUACUCCUUUACUCUCUUUACG-5'       (SEQ ID NO: 75)

HIF-1α-846 Target:    5'-GTGACCATGAGGAAATGAGAGAAATGC-3'       (SEQ ID NO: 831)

5'-CCAUGAGGAAAUGAGAGAAAUGCtt-3'         (SEQ ID NO: 454)
                      3'-CUGGUACUCCUUUACUCUCUUUACGAA-5'       (SEQ ID NO: 76)

HIF-1α-848 Target:    5'-GACCATGAGGAAATGAGAGAAATGCTT-3'       (SEQ ID NO: 832)

5'-AUGAGGAAAUGAGAGAAAUGCUUac-3'         (SEQ ID NO: 455)
                      3'-GGUACUCCUUUACUCUCUUUACGAAUG-5'       (SEQ ID NO: 77)

HIF-1α-850 Target:    5'-CCATGAGGAAATGAGAGAAATGCTTAC-3'       (SEQ ID NO: 833)

5'-GAGGAAAUGAGAGAAAUGCUUACac-3'         (SEQ ID NO: 456)
                      3'-UACUCCUUUACUCUCUUUACGAAUGUG-5'       (SEQ ID NO: 78)

HIF-1α-852 Target:    5'-ATGAGGAAATGAGAGAAATGCTTACAC-3'       (SEQ ID NO: 834)

5'-CGAAGCUUUUUUCUCAGAAUGAAgt-3'         (SEQ ID NO: 457)
                      3'-UCGCUUCGAAAAAAGAGUCUUACUUCA-5'       (SEQ ID NO: 79)

HIF-1α-921 Target:    5'-AGCGAAGCTTTTTCTCAGAATGAAGT-3'        (SEQ ID NO: 835)

5'-GCUUUUUUCUCAGAAUGAAGUGUac-3'         (SEQ ID NO: 458)
                      3'-UUCGAAAAAAGAGUCUUACUUCACAUG-5'       (SEQ ID NO: 80)

HIF-1α-925 Target:    5'-AAGCTTTTTTCTCAGAATGAAGTGTAC-3'       (SEQ ID NO: 836)

5'-UUUUUUCUCAGAAUGAAGUGUACccc-3'        (SEQ ID NO: 459)
                      3'-CGAAAAAAGAGUCUUACUUCACAUGGG-5'       (SEQ ID NO: 81)

HIF-1α-927 Target:    5'-GCTTTTTTCTCAGAATGAAGTGTACCC-3'       (SEQ ID NO: 837)

5'-UAUGAUACCAACAGUAACCAACCtc-3'         (SEQ ID NO: 460)
                      3'-AUAUACUAUGGUUGUCAUUGGUUGGAG-5'       (SEQ ID NO: 82)

HIF-1α-1029 Target:   5'-TATATGATACCAACAGTAACCAACCTC-3'       (SEQ ID NO: 838)

5'-UGAUACCAACAGUAACCAACCUCag-3'         (SEQ ID NO: 461)
                      3'-AUACUAUGGUUGUCAUUGGUUGGAGUC-5'       (SEQ ID NO: 83)
```

TABLE 2-continued

Selected Anti-HIF-1α DsiRNA Agents (Asymmetrics, HIF-1α)

```
HIF-1α-1031 Target: 5'-TATGATACCAACAGTAACCAACCTCAG-3'    (SEQ ID NO: 839)

5'-AUACCAACAGUAACCAACCUCAGtg-3'     (SEQ ID NO: 462)
                    3'-ACUAUGGUUGUCAUUGGUUGGAGUCAC-5'   (SEQ ID NO: 84)

HIF-1α-1033 Target: 5'-TGATACCAACAGTAACCAACCTCAGTG-3'    (SEQ ID NO: 840)

5'-ACCAACAGUAACCAACCUCAGUGtg-3'     (SEQ ID NO: 463)
                    3'-UAUGGUUGUCAUUGGUUGGAGUCACAC-5'   (SEQ ID NO: 85)

HIF-1α-1035 Target: 5'-ATACCAACAGTAACCAACCTCAGTGTG-3'    (SEQ ID NO: 841)

5'-CAACAGUAACCAACCUCAGUGUGgg-3'     (SEQ ID NO: 464)
                    3'-UGGUUGUCAUUGGUUGGAGUCACACCC-5'   (SEQ ID NO: 86)

HIF-1α-1037 Target: 5'-ACCAACAGTAACCAACCTCAGTGTGGG-3'    (SEQ ID NO: 842)

5'-ACAGUAACCAACCUCAGUGUGGGta-3'     (SEQ ID NO: 465)
                    3'-GUUGUCAUUGGUUGGAGUCACACCCAU-5'   (SEQ ID NO: 87)

HIF-1α-1039 Target: 5'-CAACAGTAACCAACCTCAGTGTGGGTA-3'    (SEQ ID NO: 843)

5'-AGUAACCAACCUCAGUGUGGGUAta-3'     (SEQ ID NO: 466)
                    3'-UGUCAUUGGUUGGAGUCACACCCAUAU-5'   (SEQ ID NO: 88)

HIF-1α-1041 Target: 5'-ACAGTAACCAACCTCAGTGTGGGTATA-3'    (SEQ ID NO: 844)

5'-UAACCAACCUCAGUGUGGGUAUAag-3'     (SEQ ID NO: 467)
                    3'-UCAUUGGUUGGAGUCACACCCAUAUUC-5'   (SEQ ID NO: 89)

HIF-1α-1043 Target: 5'-AGTAACCAACCTCAGTGTGGGTATAAG-3'    (SEQ ID NO: 845)

5'-ACCAACCUCAGUGUGGGUAUAAGaa-3'     (SEQ ID NO: 468)
                    3'-AUUGGUUGGAGUCACACCCAUAUUCUU-5'   (SEQ ID NO: 90)

HIF-1α-1045 Target: 5'-TAACCAACCTCAGTGTGGGTATAAGAA-3'    (SEQ ID NO: 846)

5'-CCUAUGACCUGCUUGGUGCUGAUtt-3'     (SEQ ID NO: 469)
                    3'-GUGGAUACUGGACGAACCACGACUAAA-5'   (SEQ ID NO: 91)

HIF-1α-1074 Target: 5'-CACCTATGACCTGCTTGGTGCTGATTT-3'    (SEQ ID NO: 847)

5'-CUAUGACCUGCUUGGUGCUGAUUtg-3'     (SEQ ID NO: 470)
                    3'-UGGAUACUGGACGAACCACGACUAAAC-5'   (SEQ ID NO: 92)

HIF-1α-1075 Target: 5'-ACCTATGACCTGCTTGGTGCTGATTTG-3'    (SEQ ID NO: 848)

5'-AUGACCUGCUUGGUGCUGAUUUGtg-3'     (SEQ ID NO: 471)
                    3'-GAUACUGGACGAACCACGACUAAACAC-5'   (SEQ ID NO: 93)

HIF-1α-1077 Target: 5'-CTATGACCTGCTTGGTGCTGATTTGTG-3'    (SEQ ID NO: 849)

5'-GCUUGGUGCUGAUUUGUGAACCCat-3'     (SEQ ID NO: 472)
                    3'-GACGAACCACGACUAAACACUUGGGUA-5'   (SEQ ID NO: 94)

HIF-1α-1084 Target: 5'-CTGCTTGGTGCTGATTTGTGAACCCAT-3'    (SEQ ID NO: 850)

5'-UUGGUGCUGAUUUGUGAACCCAUtc-3'     (SEQ ID NO: 473)
                    3'-CGAACCACGACUAAACACUUGGGUAAG-5'   (SEQ ID NO: 95)

HIF-1α-1086 Target: 5'-GCTTGGTGCTGATTTGTGAACCCATTC-3'    (SEQ ID NO: 851)

5'-GGUGCUGAUUUGUGAACCCAUUCct-3'     (SEQ ID NO: 474)
                    3'-AACCACGACUAAACACUUGGGUAAGGA-5'   (SEQ ID NO: 96)

HIF-1α-1088 Target: 5'-TTGGTGCTGATTTGTGAACCCATTCCT-3'    (SEQ ID NO: 852)

5'-UGCUGAUUUGUGAACCCAUUCCUca-3'     (SEQ ID NO: 475)
                    3'-CCACGACUAAACACUUGGGUAAGGAGU-5'   (SEQ ID NO: 97)

HIF-1α-1090 Target: 5'-GGTGCTGATTTGTGAACCCATTCCTCA-3'    (SEQ ID NO: 853)

5'-CUGAUUUGUGAACCCAUUCCUCAcc-3'     (SEQ ID NO: 476)
                    3'-ACGACUAAACACUUGGGUAAGGAGUGG-5'   (SEQ ID NO: 98)
```

TABLE 2-continued

Selected Anti-HIF-1α DsiRNA Agents (Asymmetrics, HIF-1α)

```
HIF-1α-1092 Target: 5'-TGCTGATTTGTGAACCCATTCCTCACC-3'      (SEQ ID NO: 854)

5'-GAUUUGUGAACCCAUUCCUCACCca-3'         (SEQ ID NO: 477)
                    3'-GACUAAACACUUGGGUAAGGAGUGGGU-5'       (SEQ ID NO:  99)

HIF-1α-1094 Target: 5'-CTGATTTGTGAACCCATTCCTCACCCA-3'      (SEQ ID NO: 855)

5'-UUUGUGAACCCAUUCCUCACCCAtc-3'         (SEQ ID NO: 478)
                    3'-CUAAACACUUGGGUAAGGAGUGGGUAG-5'       (SEQ ID NO: 100)

HIF-1α-1096 Target: 5'-GATTTGTGAACCCATTCCTCACCCATC-3'      (SEQ ID NO: 856)

5'-CAAAUAUUGAAAUUCCUUUAGAUag-3'         (SEQ ID NO: 479)
                    3'-UAGUUUAUAACUUUAAGGAAAUCUAUC-5'       (SEQ ID NO: 101)

HIF-1α-1120 Target: 5'-ATCAAATATTGAAATTCCTTTAGATAG-3'      (SEQ ID NO: 857)

5'-AAUAUUGAAAUUCCUUUAGAUAGca-3'         (SEQ ID NO: 480)
                    3'-GUUUAUAACUUUAAGGAAAUCUAUCGU-5'       (SEQ ID NO: 102)

HIF-1α-1122 Target: 5'-CAAATATTGAAATTCCTTTAGATAGCA-3'      (SEQ ID NO: 858)

5'-UAUUGAAAUUCCUUUAGAUAGCAag-3'         (SEQ ID NO: 481)
                    3'-UUAUAACUUUAAGGAAAUCUAUCGUUC-5'       (SEQ ID NO: 103)

HIF-1α-1124 Target: 5'-AATATTGAAATTCCTTTAGATAGCAAG-3'      (SEQ ID NO: 859)

5'-UUGAAAUUCCUUUAGAUAGCAAGac-3'         (SEQ ID NO: 482)
                    3'-AUAACUUUAAGGAAAUCUAUCGUUCUG-5'       (SEQ ID NO: 104)

HIF-1α-1126 Target: 5'-TATTGAAATTCCTTTAGATAGCAAGAC-3'      (SEQ ID NO: 860)

5'-GAAAUUCCUUUAGAUAGCAAGACtt-3'         (SEQ ID NO: 483)
                    3'-AACUUUAAGGAAAUCUAUCGUUCUGAA-5'       (SEQ ID NO: 105)

HIF-1α-1128 Target: 5'-TTGAAATTCCTTTAGATAGCAAGACTT-3'      (SEQ ID NO: 861)

5'-AAUUCCUUUAGAUAGCAAGACUUtc-3'         (SEQ ID NO: 484)
                    3'-CUUUAAGGAAAUCUAUCGUUCUGAAAG-5'       (SEQ ID NO: 106)

HIF-1α-1130 Target: 5'-GAAATTCCTTTAGATAGCAAGACTTTC-3'      (SEQ ID NO: 862)

5'-UUCCUUUAGAUAGCAAGACUUUCct-3'         (SEQ ID NO: 485)
                    3'-UUAAGGAAAUCUAUCGUUCUGAAAGGA-5'       (SEQ ID NO: 107)

HIF-1α-1132 Target: 5'-AATTCCTTTAGATAGCAAGACTTTCCT-3'      (SEQ ID NO: 863)

5'-CAGCCUGGAUAUGAAAUUUUCUUat-3'         (SEQ ID NO: 486)
                    3'-GUGUCGGACCUAUACUUUAAAAGAAUA-5'       (SEQ ID NO: 108)

HIF-1α-1166 Target: 5'-CACAGCCTGGATATGAAATTTTCTTAT-3'      (SEQ ID NO: 864)

5'-AUAUGAAAUUUCUUAUUGUGAUga-3'          (SEQ ID NO: 487)
                    3'-CCUAUACUUUAAAAGAAUAACACUACU-5'       (SEQ ID NO: 109)

HIF-1α-1174 Target: 5'-GGATATGAAATTTTCTTATTGTGATGA-3'      (SEQ ID NO: 865)

5'-GCCGCUCAAUUUAUGAAUAUUAUca-3'         (SEQ ID NO: 488)
                    3'-UCCGGCGAGUUAAAUACUUAUAAUAGU-5'       (SEQ ID NO: 110)

HIF-1α-1243 Target: 5'-AGGCCGCTCAATTTATGAATATTATCA-3'      (SEQ ID NO: 866)

5'-CGCUCAAUUUAUGAAUAUUAUCAtg-3'         (SEQ ID NO: 489)
                    3'-CGGCGAGUUAAAUACUUAUAAUAGUAC-5'       (SEQ ID NO: 111)

HIF-1α-1245 Target: 5'-GCCGCTCAATTTATGAATATTATCATG-3'      (SEQ ID NO: 867)

5'-CUCAAUUUAUGAAUAUUAUCAUGct-3'         (SEQ ID NO: 490)
                    3'-GCGAGUUAAAUACUUAUAAUAGUACGA-5'       (SEQ ID NO: 112)

HIF-1α-1247 Target: 5'-CGCTCAATTTATGAATATTATCATGCT-3'      (SEQ ID NO: 868)

5'-CAAUUUAUGAAUAUUAUCAUGCUtt-3'         (SEQ ID NO: 491)
                    3'-GAGUUAAAUACUUAUAAUAGUACGAAA-5'       (SEQ ID NO: 113)
```

TABLE 2-continued

Selected Anti-HIF-1α DsiRNA Agents (Asymmetrics, HIF-1α)

```
HIF-1α-1249 Target: 5'-CTCAATTTATGAATATTATCATGCTTT-3'      (SEQ ID NO: 869)

5'-AUUUAUGAAUAUUAUCAUGCUUUgg-3'        (SEQ ID NO: 492)
                    3'-GUUAAAUACUUAUAAUAGUACGAAACC-5'      (SEQ ID NO: 114)

HIF-1α-1251 Target: 5'-CAATTTATGAATATTATCATGCTTTGG-3'      (SEQ ID NO: 870)

5'-UUAUGAAUAUUAUCAUGCUUUGGac-3'        (SEQ ID NO: 493)
                    3'-UAAAUACUUAUAAUAGUACGAAACCUG-5'      (SEQ ID NO: 115)

HIF-1α-1253 Target: 5'-ATTTATGAATATTATCATGCTTTGGAC-3'      (SEQ ID NO: 871)

5'-AUGAAUAUUAUCAUGCUUUGGACtc-3'        (SEQ ID NO: 494)
                    3'-AAUACUUAUAAUAGUACGAAACCUGAG-5'      (SEQ ID NO: 116)

HIF-1α-1255 Target: 5'-TTATGAATATTATCATGCTTTGGACTC-3'      (SEQ ID NO: 872)

5'-GAAUAUUAUCAUGCUUUGGACUCtg-3'        (SEQ ID NO: 495)
                    3'-UACUUAUAAUAGUACGAAACCUGAGAC-5'      (SEQ ID NO: 117)

HIF-1α-1257 Target: 5'-ATGAATATTATCATGCTTTGGACTCTG-3'      (SEQ ID NO: 873)

5'-UUAUCAUGCUUUGGACUCUGAUCat-3'        (SEQ ID NO: 496)
                    3'-AUAAUAGUACGAAACCUGAGACUAGUA-5'      (SEQ ID NO: 118)

HIF-1α-1262 Target: 5'-TATTATCATGCTTTGGACTCTGATCAT-3'      (SEQ ID NO: 874)

5'-UCAUGCUUUGGACUCUGAUCAUCtg-3'        (SEQ ID NO: 497)
                    3'-AUAGUACGAAACCUGAGACUAGUAGAC-5'      (SEQ ID NO: 119)

HIF-1α-1265 Target: 5'-TATCATGCTTTGGACTCTGATCATCTG-3'      (SEQ ID NO: 875)

5'-UGCUUUGGACUCUGAUCAUCUGAcc-3'        (SEQ ID NO: 498)
                    3'-GUACGAAACCUGAGACUAGUAGACUGG-5'      (SEQ ID NO: 120)

HIF-1α-1268 Target: 5'-CATGCTTTGGACTCTGATCATCTGACC-3'      (SEQ ID NO: 876)

5'-UUUGGACUCUGAUCAUCUGACCAaa-3'        (SEQ ID NO: 499)
                    3'-CGAAACCUGAGACUAGUAGACUGGUUU-5'      (SEQ ID NO: 121)

HIF-1α-1271 Target: 5'-GCTTTGGACTCTGATCATCTGACCAAA-3'      (SEQ ID NO: 877)

5'-UCUGAUCAUCUGACCAAAACUCAtc-3'        (SEQ ID NO: 500)
                    3'-UGAGACUAGUAGACUGGUUUUGAGUAG-5'      (SEQ ID NO: 122)

HIF-1α-1278 Target: 5'-ACTCTGATCATCTGACCAAAACTCATC-3'      (SEQ ID NO: 878)

5'-UGAUCAUCUGACCAAAACUCAUCat-3'        (SEQ ID NO: 501)
                    3'-AGACUAGUAGACUGGUUUUGAGUAGUA-5'      (SEQ ID NO: 123)

HIF-1α-1280 Target: 5'-TCTGATCATCTGACCAAAACTCATCAT-3'      (SEQ ID NO: 879)

5'-AUCAUCUGACCAAAACUCAUCAUga-3'        (SEQ ID NO: 502)
                    3'-ACUAGUAGACUGGUUUUGAGUAGUACU-5'      (SEQ ID NO: 124)

HIF-1α-1282 Target: 5'-TGATCATCTGACCAAAACTCATCATGA-3'      (SEQ ID NO: 880)

5'-AUGAUAUGUUUACUAAAGGACAAgt-3'        (SEQ ID NO: 503)
                    3'-AGUACUAUACAAAUGAUUUCCUGUUCA-5'      (SEQ ID NO: 125)

HIF-1α-1303 Target: 5'-TCATGATATGTTTACTAAAGGACAAGT-3'      (SEQ ID NO: 881)

5'-GAUAUGUUUACUAAAGGACAAGUca-3'        (SEQ ID NO: 504)
                    3'-UACUAUACAAAUGAUUUCCUGUUCAGU-5'      (SEQ ID NO: 126)

HIF-1α-1305 Target: 5'-ATGATATGTTTACTAAAGGACAAGTCA-3'      (SEQ ID NO: 882)

5'-UAUGUUUACUAAAGGACAAGUCAcc-3'        (SEQ ID NO: 505)
                    3'-CUAUACAAAUGAUUUCCUGUUCAGUGG-5'      (SEQ ID NO: 127)

HIF-1α-1307 Target: 5'-GATATGTTTACTAAAGGACAAGTCACC-3'      (SEQ ID NO: 883)

5'-UGUUUACUAAAGGACAAGUCACCac-3'        (SEQ ID NO: 506)
                    3'-AUACAAAUGAUUUCCUGUUCAGUGGUG-5'      (SEQ ID NO: 128)
```

TABLE 2-continued

Selected Anti-HIF-1α DsiRNA Agents (Asymmetrics, HIF-1α)

```
HIF-1α-1309  Target: 5'-TATGTTTACTAAAGGACAAGTCACCAC-3'       (SEQ ID NO: 884)

5'-UUUACUAAAGGACAAGUCACCACag-3'         (SEQ ID NO: 507)
                     3'-ACAAAUGAUUUCCUGUUCAGUGGUGUC-5'       (SEQ ID NO: 129)

HIF-1α-1311  Target: 5'-TGTTTACTAAAGGACAAGTCACCACAG-3'       (SEQ ID NO: 885)

5'-UACUAAAGGACAAGUCACCACAGga-3'         (SEQ ID NO: 508)
                     3'-AAAUGAUUUCCUGUUCAGUGGUGUCCU-5'       (SEQ ID NO: 130)

HIF-1α-1313  Target: 5'-TTTACTAAAGGACAAGTCACCACAGGA-3'       (SEQ ID NO: 886)

5'-CUAAAGGACAAGUCACCACAGGAca-3'         (SEQ ID NO: 509)
                     3'-AUGAUUUCCUGUUCAGUGGUGUCCUGU-5'       (SEQ ID NO: 131)

HIF-1α-1315  Target: 5'-TACTAAAGGACAAGTCACCACAGGACA-3'       (SEQ ID NO: 887)

5'-AAAGGACAAGUCACCACAGGACAgt-3'         (SEQ ID NO: 510)
                     3'-GAUUUCCUGUUCAGUGGUGUCCUGUCA-5'       (SEQ ID NO: 132)

HIF-1α-1317  Target: 5'-CTAAAGGACAAGTCACCACAGGACAGT-3'       (SEQ ID NO: 888)

5'-AGGACAAGUCACCACAGGACAGUac-3'         (SEQ ID NO: 511)
                     3'-UUUCCUGUUCAGUGGUGUCCUGUCAUG-5'       (SEQ ID NO: 133)

HIF-1α-1319  Target: 5'-AAAGGACAAGTCACCACAGGACAGTAC-3'       (SEQ ID NO: 889)

5'-GACAAGUCACCACAGGACAGUACag-3'         (SEQ ID NO: 512)
                     3'-UCCUGUUCAGUGGUGUCCUGUCAUGUC-5'       (SEQ ID NO: 134)

HIF-1α-1321  Target: 5'-AGGACAAGTCACCACAGGACAGTACAG-3'       (SEQ ID NO: 890)

5'-CAAGUCACCACAGGACAGUACAGga-3'         (SEQ ID NO: 513)
                     3'-CUGUUCAGUGGUGUCCUGUCAUGUCCU-5'       (SEQ ID NO: 135)

HIF-1α-1323  Target: 5'-GACAAGTCACCACAGGACAGTACAGGA-3'       (SEQ ID NO: 891)

5'-AGUCACCACAGGACAGUACAGGAtg-3'         (SEQ ID NO: 514)
                     3'-GUUCAGUGGUGUCCUGUCAUGUCCUAC-5'       (SEQ ID NO: 136)

HIF-1α-1325  Target: 5'-CAAGTCACCACAGGACAGTACAGGATG-3'       (SEQ ID NO: 892)

5'-UCACCACAGGACAGUACAGGAUGct-3'         (SEQ ID NO: 515)
                     3'-UCAGUGGUGUCCUGUCAUGUCCUACGA-5'       (SEQ ID NO: 137)

HIF-1α-1327  Target: 5'-AGTCACCACAGGACAGTACAGGATGCT-3'       (SEQ ID NO: 893)

5'-ACCACAGGACAGUACAGGAUGCUtg-3'         (SEQ ID NO: 516)
                     3'-AGUGGUGUCCUGUCAUGUCCUACGAAC-5'       (SEQ ID NO: 138)

HIF-1α-1329  Target: 5'-TCACCACAGGACAGTACAGGATGCTTG-3'       (SEQ ID NO: 894)

5'-CACAGGACAGUACAGGAUGCUUGcc-3'         (SEQ ID NO: 517)
                     3'-UGGUGUCCUGUCAUGUCCUACGAACGG-5'       (SEQ ID NO: 139)

HIF-1α-1331  Target: 5'-ACCACAGGACAGTACAGGATGCTTGCC-3'       (SEQ ID NO: 895)

5'-CAGGACAGUACAGGAUGCUUGCCaa-3'         (SEQ ID NO: 518)
                     3'-GUGUCCUGUCAUGUCCUACGAACGGUU-5'       (SEQ ID NO: 140)

HIF-1α-1333  Target: 5'-CACAGGACAGTACAGGATGCTTGCCAA-3'       (SEQ ID NO: 896)

5'-GGACAGUACAGGAUGCUUGCCAAaa-3'         (SEQ ID NO: 519)
                     3'-GUCCUGUCAUGUCCUACGAACGGUUUU-5'       (SEQ ID NO: 141)

HIF-1α-1335  Target: 5'-CAGGACAGTACAGGATGCTTGCCAAAA-3'       (SEQ ID NO: 897)

5'-ACAGUACAGGAUGCUUGCCAAAAga-3'         (SEQ ID NO: 520)
                     3'-CCUGUCAUGUCCUACGAACGGUUUUCU-5'       (SEQ ID NO: 142)

HIF-1α-1337  Target: 5'-GGACAGTACAGGATGCTTGCCAAAAGA-3'       (SEQ ID NO: 898)

5'-AGUACAGGAUGCUUGCCAAAAGAgg-3'         (SEQ ID NO: 521)
                     3'-UGUCAUGUCCUACGAACGGUUUUCUCC-5'       (SEQ ID NO: 143)
```

TABLE 2-continued

Selected Anti-HIF-1α DsiRNA Agents (Asymmetrics, HIF-1α)

```
HIF-1α-1339 Target: 5'-ACAGTACAGGATGCTTGCCAAAAGAGG-3'   (SEQ ID NO: 899)

5'-UACAGGAUGCUUGCCAAAAGAGGtg-3'     (SEQ ID NO: 522)
                    3'-UCAUGUCCUACGAACGGUUUUCUCCAC-5'   (SEQ ID NO: 144)

HIF-1α-1341 Target: 5'-AGTACAGGATGCTTGCCAAAAGAGGTG-3'   (SEQ ID NO: 900)

5'-CAGGAUGCUUGCCAAAAGAGGUGga-3'     (SEQ ID NO: 523)
                    3'-AUGUCCUACGAACGGUUUUCUCCACCU-5'   (SEQ ID NO: 145)

HIF-1α-1343 Target: 5'-TACAGGATGCTTGCCAAAAGAGGTGGA-3'   (SEQ ID NO: 901)

5'-GGAUGCUUGCCAAAAGAGGUGGAta-3'     (SEQ ID NO: 524)
                    3'-GUCCUACGAACGGUUUUCUCCACCUAU-5'   (SEQ ID NO: 146)

HIF-1α-1345 Target: 5'-CAGGATGCTTGCCAAAAGAGGTGGATA-3'   (SEQ ID NO: 902)

5'-AUGCUUGCCAAAAGAGGUGGAUAtg-3'     (SEQ ID NO: 525)
                    3'-CCUACGAACGGUUUUCUCCACCUAUAC-5'   (SEQ ID NO: 147)

HIF-1α-1347 Target: 5'-GGATGCTTGCCAAAAGAGGTGGATATG-3'   (SEQ ID NO: 903)

5'-GCUUGCCAAAAGAGGUGGAUAUGtc-3'     (SEQ ID NO: 526)
                    3'-UACGAACGGUUUUCUCCACCUAUACAG-5'   (SEQ ID NO: 148)

HIF-1α-1349 Target: 5'-ATGCTTGCCAAAAGAGGTGGATATGTC-3'   (SEQ ID NO: 904)

5'-UUGCCAAAAGAGGUGGAUAUGUCtg-3'     (SEQ ID NO: 527)
                    3'-CGAACGGUUUUCUCCACCUAUACAGAC-5'   (SEQ ID NO: 149)

HIF-1α-1351 Target: 5'-GCTTGCCAAAAGAGGTGGATATGTCTG-3'   (SEQ ID NO: 905)

5'-GCCAAAAGAGGUGGAUAUGUCUGgg-3'     (SEQ ID NO: 528)
                    3'-AACGGUUUUCUCCACCUAUACAGACCC-5'   (SEQ ID NO: 150)

HIF-1α-1353 Target: 5'-TTGCCAAAAGAGGTGGATATGTCTGGG-3'   (SEQ ID NO: 906)

5'-CAAAAGAGGUGGAUAUGUCUGGGtt-3'     (SEQ ID NO: 529)
                    3'-CGGUUUUCUCCACCUAUACAGACCCAA-5'   (SEQ ID NO: 151)

HIF-1α-1355 Target: 5'-GCCAAAAGAGGTGGATATGTCTGGGTT-3'   (SEQ ID NO: 907)

5'-AAAGAGGUGGAUAUGUCUGGGUUga-3'     (SEQ ID NO: 530)
                    3'-GUUUUCUCCACCUAUACAGACCCAACU-5'   (SEQ ID NO: 152)

HIF-1α-1357 Target: 5'-CAAAAGAGGTGGATATGTCTGGGTTGA-3'   (SEQ ID NO: 908)

5'-AGAGGUGGAUAUGUCUGGGUUGAaa-3'     (SEQ ID NO: 531)
                    3'-UUUCUCCACCUAUACAGACCCAACUUU-5'   (SEQ ID NO: 153)

HIF-1α-1359 Target: 5'-AAAGAGGTGGATATGTCTGGGTTGAAA-3'   (SEQ ID NO: 909)

5'-AGGUGGAUAUGUCUGGGUUGAAAct-3'     (SEQ ID NO: 532)
                    3'-UCUCCACCUAUACAGACCCAACUUUGA-5'   (SEQ ID NO: 154)

HIF-1α-1361 Target: 5'-AGAGGTGGATATGTCTGGGTTGAAACT-3'   (SEQ ID NO: 910)

5'-GUGGAUAUGUCUGGGUUGAAACUca-3'     (SEQ ID NO: 533)
                    3'-UCCACCUAUACAGACCCAACUUUGAGU-5'   (SEQ ID NO: 155)

HIF-1α-1363 Target: 5'-AGGTGGATATGTCTGGGTTGAAACTCA-3'   (SEQ ID NO: 911)

5'-GGAUAUGUCUGGGUUGAAACUCAag-3'     (SEQ ID NO: 534)
                    3'-CACCUAUACAGACCCAACUUUGAGUUC-5'   (SEQ ID NO: 156)

HIF-1α-1365 Target: 5'-GTGGATATGTCTGGGTTGAAACTCAAG-3'   (SEQ ID NO: 912)

5'-AUAUGUCUGGGUUGAAACUCAAGca-3'     (SEQ ID NO: 535)
                    3'-CCUAUACAGACCCAACUUUGAGUUCGU-5'   (SEQ ID NO: 157)

HIF-1α-1367 Target: 5'-GGATATGTCTGGGTTGAAACTCAAGCA-3'   (SEQ ID NO: 913)

5'-AUGUCUGGGUUGAAACUCAAGCAac-3'     (SEQ ID NO: 536)
                    3'-UAUACAGACCCAACUUUGAGUUCGUUG-5'   (SEQ ID NO: 158)
```

TABLE 2-continued

Selected Anti-HIF-1α DsiRNA Agents (Asymmetrics, HIF-1α)

```
HIF-1α-1369  Target: 5'-ATATGTCTGGGTTGAAACTCAAGCAAC-3'     (SEQ ID NO: 914)

5'-GUCUGGGUUGAAACUCAAGCAACtg-3'      (SEQ ID NO: 537)
                     3'-UACAGACCCAACUUUGAGUUCGUUGAC-5'    (SEQ ID NO: 159)

HIF-1α-1371  Target: 5'-ATGTCTGGGTTGAAACTCAAGCAACTG-3'    (SEQ ID NO: 915)

5'-CUGGGUUGAAACUCAAGCAACUGtc-3'      (SEQ ID NO: 538)
                     3'-CAGACCCAACUUUGAGUUCGUUGACAG-5'    (SEQ ID NO: 160)

HIF-1α-1373  Target: 5'-GTCTGGGTTGAAACTCAAGCAACTGTC-3'    (SEQ ID NO: 916)

5'-GGGUUGAAACUCAAGCAACUGUCat-3'      (SEQ ID NO: 539)
                     3'-GACCCAACUUUGAGUUCGUUGACAGUA-5'    (SEQ ID NO: 161)

HIF-1α-1375  Target: 5'-CTGGGTTGAAACTCAAGCAACTGTCAT-3'    (SEQ ID NO: 917)

5'-GUUGAAACUCAAGCAACUGUCAUat-3'      (SEQ ID NO: 540)
                     3'-CCCAACUUUGAGUUCGUUGACAGUAUA-5'    (SEQ ID NO: 162)

HIF-1α-1377  Target: 5'-GGGTTGAAACTCAAGCAACTGTCATAT-3'    (SEQ ID NO: 918)

5'-UGAAACUCAAGCAACUGUCAUAUat-3'      (SEQ ID NO: 541)
                     3'-CAACUUUGAGUUCGUUGACAGUAUAUA-5'    (SEQ ID NO: 163)

HIF-1α-1379  Target: 5'-GTTGAAACTCAAGCAACTGTCATATAT-3'    (SEQ ID NO: 919)

5'-AAACUCAAGCAACUGUCAUAUAUaa-3'      (SEQ ID NO: 542)
                     3'-ACUUUGAGUUCGUUGACAGUAUAUAUU-5'    (SEQ ID NO: 164)

HIF-1α-1381  Target: 5'-TGAAACTCAAGCAACTGTCATATATAA-3'    (SEQ ID NO: 920)

5'-ACUCAAGCAACUGUCAUAUAUAACa-3'      (SEQ ID NO: 543)
                     3'-UUUGAGUUCGUUGACAGUAUAUAUUGU-5'    (SEQ ID NO: 165)

HIF-1α-1383  Target: 5'-AAACTCAAGCAACTGTCATATATAACA-3'    (SEQ ID NO: 921)

5'-UCAAGCAACUGUCAUAUAUAACAcc-3'      (SEQ ID NO: 544)
                     3'-UGAGUUCGUUGACAGUAUAUAUUGUGG-5'    (SEQ ID NO: 166)

HIF-1α-1385  Target: 5'-ACTCAAGCAACTGTCATATATAACACC-3'    (SEQ ID NO: 922)

5'-AAGCAACUGUCAUAUAUAACACCaa-3'      (SEQ ID NO: 545)
                     3'-AGUUCGUUGACAGUAUAUAUUGUGGUU-5'    (SEQ ID NO: 167)

HIF-1α-1387  Target: 5'-TCAAGCAACTGTCATATATAACACCAA-3'    (SEQ ID NO: 923)

5'-GUGGUAUUAUUCAGCACGACUUGat-3'      (SEQ ID NO: 546)
                     3'-CUCACCAUAAUAAGUCGUGCUGAACUA-5'    (SEQ ID NO: 168)

HIF-1α-1456  Target: 5'-GAGTGGTATTATTCAGCACGACTTGAT-3'    (SEQ ID NO: 924)

5'-GGUAUUAUUCAGCACGACUUGAUtt-3'      (SEQ ID NO: 547)
                     3'-CACCAUAAUAAGUCGUGCUGAACUAAA-5'    (SEQ ID NO: 169)

HIF-1α-1458  Target: 5'-GTGGTATTATTCAGCACGACTTGATTT-3'    (SEQ ID NO: 925)

5'-UAUUAUUCAGCACGACUUGAUUUtc-3'      (SEQ ID NO: 548)
                     3'-CCAUAAUAAGUCGUGCUGAACUAAAAG-5'    (SEQ ID NO: 170)

HIF-1α-1460  Target: 5'-GGTATTATTCAGCACGACTTGATTTTC-3'    (SEQ ID NO: 926)

5'-UUAUUCAGCACGACUUGAUUUUCtc-3'      (SEQ ID NO: 549)
                     3'-AUAAUAAGUCGUGCUGAACUAAAAGAG-5'    (SEQ ID NO: 171)

HIF-1α-1462  Target: 5'-TATTATTCAGCACGACTTGATTTTCTC-3'    (SEQ ID NO: 927)

5'-AUUCAGCACGACUUGAUUUUCUCcc-3'      (SEQ ID NO: 550)
                     3'-AAUAAGUCGUGCUGAACUAAAAGAGGG-5'    (SEQ ID NO: 172)

HIF-1α-1464  Target: 5'-TTATTCAGCACGACTTGATTTTCTCCC-3'    (SEQ ID NO: 928)

5'-UCAGCACGACUUGAUUUUCUCCCtt-3'      (SEQ ID NO: 551)
                     3'-UAAGUCGUGCUGAACUAAAAGAGGGAA-5'    (SEQ ID NO: 173)
```

TABLE 2-continued

Selected Anti-HIF-1α DsiRNA Agents (Asymmetrics, HIF-1α)

```
HIF-1α-1466 Target: 5'-ATTCAGCACGACTTGATTTTCTCCCTT-3'     (SEQ ID NO: 929)

5'-AGCACGACUUGAUUUUCUCCCUUca-3'       (SEQ ID NO: 552)
                    3'-AGUCGUGCUGAACUAAAAGAGGGAAGU-5'     (SEQ ID NO: 174)

HIF-1α-1468 Target: 5'-TCAGCACGACTTGATTTTCTCCCTTCA-3'     (SEQ ID NO: 930)

5'-CACGACUUGAUUUUCUCCCUUCAac-3'       (SEQ ID NO: 553)
                    3'-UCGUGCUGAACUAAAAGAGGGAAGUUG-5'     (SEQ ID NO: 175)

HIF-1α-1470 Target: 5'-AGCACGACTTGATTTTCTCCCTTCAAC-3'     (SEQ ID NO: 931)

5'-CGACUUGAUUUUCUCCCUUCAACaa-3'       (SEQ ID NO: 554)
                    3'-GUGCUGAACUAAAAGAGGGAAGUUGUU-5'     (SEQ ID NO: 176)

HIF-1α-1472 Target: 5'-CACGACTTGATTTTCTCCCTTCAACAA-3'     (SEQ ID NO: 932)

5'-ACUUGAUUUUCUCCCUUCAACAAac-3'       (SEQ ID NO: 555)
                    3'-GCUGAACUAAAAGAGGGAAGUUGUUUG-5'     (SEQ ID NO: 177)

HIF-1α-1474 Target: 5'-CGACTTGATTTTCTCCCTTCAACAAAC-3'     (SEQ ID NO: 933)

5'-UUGAUUUUCUCCCUUCAACAAACag-3'       (SEQ ID NO: 556)
                    3'-UGAACUAAAAGAGGGAAGUUGUUUGUC-5'     (SEQ ID NO: 178)

HIF-1α-1476 Target: 5'-ACTTGATTTTCTCCCTTCAACAAACAG-3'     (SEQ ID NO: 934)

5'-GAUUUUCUCCCUUCAACAAACAGaa-3'       (SEQ ID NO: 557)
                    3'-AACUAAAAGAGGGAAGUUGUUUGUCUU-5'     (SEQ ID NO: 179)

HIF-1α-1478 Target: 5'-TTGATTTTCTCCCTTCAACAAACAGAA-3'     (SEQ ID NO: 935)

5'-UUUUCUCCCUUCAACAAACAGAAtg-3'       (SEQ ID NO: 558)
                    3'-CUAAAAGAGGGAAGUUGUUUGUCUUAC-5'     (SEQ ID NO: 180)

HIF-1α-1480 Target: 5'-GATTTTCTCCCTTCAACAAACAGAATG-3'     (SEQ ID NO: 936)

5'-UUCUCCCUUCAACAAACAGAAUGtg-3'       (SEQ ID NO: 559)
                    3'-AAAAGAGGGAAGUUGUUUGUCUUACAC-5'     (SEQ ID NO: 181)

HIF-1α-1482 Target: 5'-TTTTCTCCCTTCAACAAACAGAATGTG-3'     (SEQ ID NO: 937)

5'-UUGAAUCUUCAGAUAUGAAAAUGac-3'       (SEQ ID NO: 560)
                    3'-CCAACUUAGAAGUCUAUACUUUUACUG-5'     (SEQ ID NO: 182)

HIF-1α-1519 Target: 5'-GGTTGAATCTTCAGATATGAAAATGAC-3'     (SEQ ID NO: 938)

5'-UCACCAAAGUUGAAUCAGAAGAUac-3'       (SEQ ID NO: 561)
                    3'-UAAGUGGUUUCAACUUAGUCUUCUAUG-5'     (SEQ ID NO: 183)

HIF-1α-1552 Target: 5'-ATTCACCAAAGTTGAATCAGAAGATAC-3'     (SEQ ID NO: 939)

5'-GAUACAAGUAGCCUCUUUGACAAac-3'       (SEQ ID NO: 562)
                    3'-UUCUAUGUUCAUCGGAGAAACUGUUUG-5'     (SEQ ID NO: 184)

HIF-1α-1572 Target: 5'-AAGATACAAGTAGCCTCTTTGACAAAC-3'     (SEQ ID NO: 940)

5'-CAAUCAUAUCUUUAGAUUUUGGCag-3'       (SEQ ID NO: 563)
                    3'-GUGUUAGUAUAGAAAUCUAAAACCGUC-5'     (SEQ ID NO: 185)

HIF-1α-1648 Target: 5'-CACAATCATATCTTTAGATTTTGGCAG-3'     (SEQ ID NO: 941)

5'-AGUACCAUUAUAUAAUGAUGUAAtg-3'       (SEQ ID NO: 564)
                    3'-CUUCAUGGUAAUAUAUUACUACAUUAC-5'     (SEQ ID NO: 186)

HIF-1α-1709 Target: 5'-GAAGTACCATTATATAATGATGTAATG-3'     (SEQ ID NO: 942)

5'-CAUUAUAUAAUGAUGUAAUGCUCcc-3'       (SEQ ID NO: 565)
                    3'-UGGUAAUAUAUUACUACAUUACGAGGG-5'     (SEQ ID NO: 187)

HIF-1α-1714 Target: 5'-ACCATTATATAATGATGTAATGCTCCC-3'     (SEQ ID NO: 943)

5'-UACCCACCGCUGAAACGCCAAAGcc-3'       (SEQ ID NO: 566)
                    3'-UAAUGGGUGGCGACUUUGCGGUUUCGG-5'     (SEQ ID NO: 188)
```

TABLE 2-continued

Selected Anti-HIF-1α DsiRNA Agents (Asymmetrics, HIF-1α)

```
HIF-1α-1786 Target: 5'-ATTACCCACCGCTGAAACGCCAAAGCC-3'    (SEQ ID NO: 944)

5'-CAAAGCCACUUCGAAGUAGUGCUga-3'      (SEQ ID NO: 567)
                    3'-CGGUUUCGGUGAAGCUUCAUCACGACU-5'    (SEQ ID NO: 189)

HIF-1α-1804 Target: 5'-GCCAAAGCCACTTCGAAGTAGTGCTGA-3'    (SEQ ID NO: 945)

5'-AAGCCACUUCGAAGUAGUGCUGAcc-3'      (SEQ ID NO: 568)
                    3'-GUUUCGGUGAAGCUUCAUCACGACUGG-5'    (SEQ ID NO: 190)

HIF-1α-1806 Target: 5'-CAAAGCCACTTCGAAGTAGTGCTGACC-3'    (SEQ ID NO: 946)

5'-GCCACUUCGAAGUAGUGCUGACCct-3'      (SEQ ID NO: 569)
                    3'-UUCGGUGAAGCUUCAUCACGACUGGGA-5'    (SEQ ID NO: 191)

HIF-1α-1808 Target: 5'-AAGCCACTTCGAAGTAGTGCTGACCCT-3'    (SEQ ID NO: 947)

5'-CACUUCGAAGUAGUGCUGACCCUgc-3'      (SEQ ID NO: 570)
                    3'-CGGUGAAGCUUCAUCACGACUGGGACG-5'    (SEQ ID NO: 192)

HIF-1α-1810 Target: 5'-GCCACTTCGAAGTAGTGCTGACCCTGC-3'    (SEQ ID NO: 948)

5'-UCGAAGUAGUGCUGACCCUGCACtc-3'      (SEQ ID NO: 571)
                    3'-GAAGCUUCAUCACGACUGGGACGUGAG-5'    (SEQ ID NO: 193)

HIF-1α-1814 Target: 5'-CTTCGAAGTAGTGCTGACCCTGCACTC-3'    (SEQ ID NO: 949)

5'-GAAGUUGCAUUAAAAUUAGAACCaa-3'      (SEQ ID NO: 572)
                    3'-UUCUUCAACGUAAUUUUAAUCUUGGUU-5'    (SEQ ID NO: 194)

HIF-1α-1845 Target: 5'-AAGAAGTTGCATTAAAATTAGAACCAA-3'    (SEQ ID NO: 950)

5'-AUGGAAGCACUAGACAAAGUUCAcc-3'      (SEQ ID NO: 573)
                    3'-GCUACCUUCGUGAUCUGUUUCAAGUGG-5'    (SEQ ID NO: 195)

HIF-1α-1936 Target: 5'-CGATGGAAGCACTAGACAAAGTTCACC-3'    (SEQ ID NO: 951)

5'-GGAAGCACUAGACAAAGUUCACCtg-3'      (SEQ ID NO: 574)
                    3'-UACCUUCGUGAUCUGUUUCAAGUGGAC-5'    (SEQ ID NO: 196)

HIF-1α-1938 Target: 5'-ATGGAAGCACTAGACAAAGTTCACCTG-3'    (SEQ ID NO: 952)

5'-AAGCACUAGACAAAGUUCACCUGag-3'      (SEQ ID NO: 575)
                    3'-CCUUCGUGAUCUGUUUCAAGUGGACUC-5'    (SEQ ID NO: 197)

HIF-1α-1940 Target: 5'-GGAAGCACTAGACAAAGTTCACCTGAG-3'    (SEQ ID NO: 953)

5'-GCACUAGACAAAGUUCACCUGAGcc-3'      (SEQ ID NO: 576)
                    3'-UUCGUGAUCUGUUUCAAGUGGACUCGG-5'    (SEQ ID NO: 198)

HIF-1α-1942 Target: 5'-AAGCACTAGACAAAGTTCACCTGAGCC-3'    (SEQ ID NO: 954)

5'-ACUAGACAAAGUUCACCUGAGCCta-3'      (SEQ ID NO: 577)
                    3'-CGUGAUCUGUUUCAAGUGGACUCGGAU-5'    (SEQ ID NO: 199)

HIF-1α-1944 Target: 5'-GCACTAGACAAAGTTCACCTGAGCCTA-3'    (SEQ ID NO: 955)

5'-UAGACAAAGUUCACCUGAGCCUAat-3'      (SEQ ID NO: 578)
                    3'-UGAUCUGUUUCAAGUGGACUCGGAUUA-5'    (SEQ ID NO: 200)

HIF-1α-1946 Target: 5'-ACTAGACAAAGTTCACCTGAGCCTAAT-3'    (SEQ ID NO: 956)

5'-AGUGAAUAUUGUUUUUAUGUGGAta-3'      (SEQ ID NO: 579)
                    3'-GGUCACUUAUAACAAAAAUACACCUAU-5'    (SEQ ID NO: 201)

HIF-1α-1977 Target: 5'-CCAGTGAATATTGTTTTTATGTGGATA-3'    (SEQ ID NO: 957)

5'-UUGUUUUUAUGUGGAUAGUGAUAtg-3'      (SEQ ID NO: 580)
                    3'-AUAACAAAAAUACACCUAUCACUAUAC-5'    (SEQ ID NO: 202)

HIF-1α-1985 Target: 5'-TATTGTTTTTATGTGGATAGTGATATG-3'    (SEQ ID NO: 958)

5'-GUAGAAAAACUUUUUGCUGAAGAca-3'      (SEQ ID NO: 581)
                    3'-ACCAUCUUUUUGAAAAACGACUUCUGU-5'    (SEQ ID NO: 203)
```

TABLE 2-continued

Selected Anti-HIF-1α DsiRNA Agents (Asymmetrics, HIF-1α)

```
HIF-1α-2034  Target: 5'-TGGTAGAAAAACTTTTGCTGAAGACA-3'      (SEQ ID NO: 959)

5'-CUCCCUAUAUCCCAAUGGAUGAUga-3'       (SEQ ID NO: 582)
                     3'-UCGAGGGAUAUAGGGUUACCUACUACU-5'     (SEQ ID NO: 204)

HIF-1α-2116  Target: 5'-AGCTCCCTATATCCCAATGGATGATGA-3'    (SEQ ID NO: 960)

5'-CCCUAUAUCCCAAUGGAUGAUGAct-3'       (SEQ ID NO: 583)
                     3'-GAGGGAUAUAGGGUUACCUACUACUGA-5'     (SEQ ID NO: 205)

HIF-1α-2118  Target: 5'-CTCCCTATATCCCAATGGATGATGACT-3'    (SEQ ID NO: 961)

5'-CUAUAUCCCAAUGGAUGAUGACUtc-3'       (SEQ ID NO: 584)
                     3'-GGGAUAUAGGGUUACCUACUACUGAAG-5'     (SEQ ID NO: 206)

HIF-1α-2120  Target: 5'-CCCTATATCCCAATGGATGATGACTTC-3'    (SEQ ID NO: 962)

5'-AUAUCCCAAUGGAUGAUGACUUCca-3'       (SEQ ID NO: 585)
                     3'-GAUAUAGGGUUACCUACUACUGAAGGU-5'     (SEQ ID NO: 207)

HIF-1α-2122  Target: 5'-CTATATCCCAATGGATGATGACTTCCA-3'    (SEQ ID NO: 963)

5'-AUCAGUUGUCACCAUUAGAAAGCag-3'       (SEQ ID NO: 586)
                     3'-GCUAGUCAACAGUGGUAAUCUUUCGUC-5'     (SEQ ID NO: 208)

HIF-1α-2161  Target: 5'-CGATCAGTTGTCACCATTAGAAAGCAG-3'    (SEQ ID NO: 964)

5'-GUUCCGCAAGCCCUGAAAGCGCAag-3'       (SEQ ID NO: 587)
                     3'-GUCAAGGCGUUCGGGACUUUCGCGUUC-5'     (SEQ ID NO: 209)

HIF-1α-2185  Target: 5'-CAGTTCCGCAAGCCCTGAAAGCGCAAG-3'    (SEQ ID NO: 965)

5'-UCCGCAAGCCCUGAAAGCGCAAGtc-3'       (SEQ ID NO: 588)
                     3'-CAAGGCGUUCGGGACUUUCGCGUUCAG-5'     (SEQ ID NO: 210)

HIF-1α-2187  Target: 5'-GTTCCGCAAGCCCTGAAAGCGCAAGTC-3'    (SEQ ID NO: 966)

5'-CUGAUGAAUUAAAAACAGUGACAaa-3'       (SEQ ID NO: 589)
                     3'-GUGACUACUUAAUUUUUGUCACUGUUU-5'     (SEQ ID NO: 211)

HIF-1α-2290  Target: 5'-CACTGATGAATTAAAAACAGTGACAAA-3'    (SEQ ID NO: 967)

5'-AAGACAUUAAAAUAUUGAUUGCAtc-3'       (SEQ ID NO: 590)
                     3'-CCUUCUGUAAUUUUAUAACUAACGUAG-5'     (SEQ ID NO: 212)

HIF-1α-2326  Target: 5'-GGAAGACATTAAAATATTGATTGCATC-3'    (SEQ ID NO: 968)

5'-GAGUCAUAGAACAGACAGAAAAAtc-3'       (SEQ ID NO: 591)
                     3'-UCCUCAGUAUCUUGUCUGUCUUUUUAG-5'     (SEQ ID NO: 213)

HIF-1α-2452  Target: 5'-AGGAGTCATAGAACAGACAGAAAAATC-3'    (SEQ ID NO: 969)

5'-GAUACUAGCUUUGCAGAAUGCUCag-3'       (SEQ ID NO: 592)
                     3'-UUCUAUGAUCGAAACGUCUUACGAGUC-5'     (SEQ ID NO: 214)

HIF-1α-2555  Target: 5'-AAGATACTAGCTTTGCAGAATGCTCAG-3'    (SEQ ID NO: 970)

5'-CAGAGAAAGCGAAAAAUGGAACAtg-3'       (SEQ ID NO: 593)
                     3'-GAGUCUCUUUCGCUUUUUACCUUGUAC-5'     (SEQ ID NO: 215)

HIF-1α-2577  Target: 5'-CTCAGAGAAAGCGAAAAATGGAACATG-3'    (SEQ ID NO: 971)

5'-AGCGAAAAAUGGAACAUGAUGGUtc-3'       (SEQ ID NO: 594)
                     3'-UUUCGCUUUUUACCUUGUACUACCAAG-5'     (SEQ ID NO: 216)

HIF-1α-2584  Target: 5'-AAAGCGAAAAATGGAACATGATGGTTC-3'    (SEQ ID NO: 972)

5'-CGAAAAAUGGAACAUGAUGGUUCac-3'       (SEQ ID NO: 595)
                     3'-UCGCUUUUUACCUUGUACUACCAAGUG-5'     (SEQ ID NO: 217)

HIF-1α-2586  Target: 5'-AGCGAAAAATGGAACATGATGGTTCAC-3'    (SEQ ID NO: 973)

5'-AGCAGUAGGAAUUGGAACAUUAUta-3'       (SEQ ID NO: 596)
                     3'-GUUCGUCAUCCUUAACCUUGUAAUAAU-5'     (SEQ ID NO: 218)
```

TABLE 2-continued

Selected Anti-HIF-1α DsiRNA Agents (Asymmetrics, HIF-1α)

```
HIF-1α-2618  Target: 5'-CAAGCAGTAGGAATTGGAACATTATTA-3'   (SEQ ID NO: 974)

5'-AUCUAGUGAACAGAAUGGAAUGGag-3'     (SEQ ID NO: 597)
                     3'-UUUAGAUCACUUGUCUUACCUUACCUC-5'   (SEQ ID NO: 219)

HIF-1α-2705  Target: 5'-AAATCTAGTGAACAGAATGGAATGGAG-3'   (SEQ ID NO: 975)

5'-CAAAAGACAAUUAUUUAAUACCct-3'      (SEQ ID NO: 598)
                     3'-UCGUUUUCUGUUAAUAAAAUUAUGGGA-5'   (SEQ ID NO: 220)

HIF-1α-2730  Target: 5'-AGCAAAAGACAATTATTTTAATACCCT-3'   (SEQ ID NO: 976)

5'-AGUGGAUUACCACAGCUGACCAGtt-3'     (SEQ ID NO: 599)
                     3'-UUUCACCUAAUGGUGUCGACUGGUCAA-5'   (SEQ ID NO: 221)

HIF-1α-2796  Target: 5'-AAAGTGGATTACCACAGCTGACCAGTT-3'   (SEQ ID NO: 977)

5'-UGGAUUACCACAGCUGACCAGUUat-3'     (SEQ ID NO: 600)
                     3'-UCACCUAAUGGUGUCGACUGGUCAAUA-5'   (SEQ ID NO: 222)

HIF-1α-2798  Target: 5'-AGTGGATTACCACAGCTGACCAGTTAT-3'   (SEQ ID NO: 978)

5'-GAUUACCACAGCUGACCAGUUAUga-3'     (SEQ ID NO: 601)
                     3'-ACCUAAUGGUGUCGACUGGUCAAUACU-5'   (SEQ ID NO: 223)

HIF-1α-2800  Target: 5'-TGGATTACCACAGCTGACCAGTTATGA-3'   (SEQ ID NO: 979)

5'-UUACCACAGCUGACCAGUUAUGAtt-3'     (SEQ ID NO: 602)
                     3'-CUAAUGGUGUCGACUGGUCAAUACUAA-5'   (SEQ ID NO: 224)

HIF-1α-2802  Target: 5'-GATTACCACAGCTGACCAGTTATGATT-3'   (SEQ ID NO: 980)

5'-GAUUGUGAAGUUAAUGCUCCUAUac-3'     (SEQ ID NO: 603)
                     3'-UACUAACACUUCAAUUACGAGGAUAUG-5'   (SEQ ID NO: 225)

HIF-1α-2823  Target: 5'-ATGATTGTGAAGTTAATGCTCCTATAC-3'   (SEQ ID NO: 981)

5'-AUACAAGGCAGCAGAAACCUACUgc-3'     (SEQ ID NO: 604)
                     3'-GAUAUGUUCCGUCGUCUUUGGAUGACG-5'   (SEQ ID NO: 226)

HIF-1α-2844  Target: 5'-CTATACAAGGCAGCAGAAACCTACTGC-3'   (SEQ ID NO: 982)

5'-ACAAGGCAGCAGAAACCUACUGCag-3'     (SEQ ID NO: 605)
                     3'-UAUGUUCCGUCGUCUUUGGAUGACGUC-5'   (SEQ ID NO: 227)

HIF-1α-2846  Target: 5'-ATACAAGGCAGCAGAAACCTACTGCAG-3'   (SEQ ID NO: 983)

5'-AAGGCAGCAGAAACCUACUGCAGgg-3'     (SEQ ID NO: 606)
                     3'-UGUUCCGUCGUCUUUGGAUGACGUCCC-5'   (SEQ ID NO: 228)

HIF-1α-2848  Target: 5'-ACAAGGCAGCAGAAACCTACTGCAGGG-3'   (SEQ ID NO: 984)

5'-GGCAGCAGAAACCUACUGCAGGGtg-3'     (SEQ ID NO: 607)
                     3'-UUCCGUCGUCUUUGGAUGACGUCCCAC-5'   (SEQ ID NO: 229)

HIF-1α-2850  Target: 5'-AAGGCAGCAGAAACCTACTGCAGGGTG-3'   (SEQ ID NO: 985)

5'-CAGCAGAAACCUACUGCAGGGUGaa-3'     (SEQ ID NO: 608)
                     3'-CCGUCGUCUUUGGAUGACGUCCCACUU-5'   (SEQ ID NO: 230)

HIF-1α-2852  Target: 5'-GGCAGCAGAAACCTACTGCAGGGTGAA-3'   (SEQ ID NO: 986)

5'-GCAGAAACCUACUGCAGGGUGAAga-3'     (SEQ ID NO: 609)
                     3'-GUCGUCUUUGGAUGACGUCCCACUUCU-5'   (SEQ ID NO: 231)

HIF-1α-2854  Target: 5'-CAGCAGAAACCTACTGCAGGGTGAAGA-3'   (SEQ ID NO: 987)

5'-AGAAACCUACUGCAGGGUGAAGAat-3'     (SEQ ID NO: 610)
                     3'-CGUCUUUGGAUGACGUCCCACUUCUUA-5'   (SEQ ID NO: 232)

HIF-1α-2856  Target: 5'-GCAGAAACCTACTGCAGGGTGAAGAAT-3'   (SEQ ID NO: 988)

5'-AAACCUACUGCAGGGUGAAGAAUta-3'     (SEQ ID NO: 611)
                     3'-UCUUUGGAUGACGUCCCACUUCUUAAU-5'   (SEQ ID NO: 233)
```

TABLE 2-continued

Selected Anti-HIF-1α DsiRNA Agents (Asymmetrics, HIF-1α)

```
HIF-1α-2858  Target: 5'-AGAAACCTACTGCAGGGTGAAGAATTA-3'     (SEQ ID NO: 989)

5'-ACCUACUGCAGGGUGAAGAAUUAct-3'       (SEQ ID NO: 612)
                     3'-UUUGGAUGACGUCCCACUUCUUAAUGA-5'     (SEQ ID NO: 234)

HIF-1α-2860  Target: 5'-AAACCTACTGCAGGGTGAAGAATTACT-3'     (SEQ ID NO: 990)

5'-CUACUGCAGGGUGAAGAAUUACUca-3'       (SEQ ID NO: 613)
                     3'-UGGAUGACGUCCCACUUCUUAAUGAGU-5'     (SEQ ID NO: 235)

HIF-1α-2862  Target: 5'-ACCTACTGCAGGGTGAAGAATTACTCA-3'     (SEQ ID NO: 991)

5'-ACUGCAGGGUGAAGAAUUACUCAga-3'       (SEQ ID NO: 614)
                     3'-GAUGACGUCCCACUUCUUAAUGAGUCU-5'     (SEQ ID NO: 236)

HIF-1α-2864  Target: 5'-CTACTGCAGGGTGAAGAATTACTCAGA-3'     (SEQ ID NO: 992)

5'-UGCAGGGUGAAGAAUUACUCAGAgc-3'       (SEQ ID NO: 615)
                     3'-UGACGUCCCACUUCUUAAUGAGUCUCG-5'     (SEQ ID NO: 237)

HIF-1α-2866  Target: 5'-ACTGCAGGGTGAAGAATTACTCAGAGC-3'     (SEQ ID NO: 993)

5'-CAGGGUGAAGAAUUACUCAGAGCtt-3'       (SEQ ID NO: 616)
                     3'-ACGUCCCACUUCUUAAUGAGUCUCGAA-5'     (SEQ ID NO: 238)

HIF-1α-2868  Target: 5'-TGCAGGGTGAAGAATTACTCAGAGCTT-3'     (SEQ ID NO: 994)

5'-GGGUGAAGAAUUACUCAGAGCUUtg-3'       (SEQ ID NO: 617)
                     3'-GUCCCACUUCUUAAUGAGUCUCGAAAC-5'     (SEQ ID NO: 239)

HIF-1α-2870  Target: 5'-CAGGGTGAAGAATTACTCAGAGCTTTG-3'     (SEQ ID NO: 995)

5'-GUGAAGAAUUACUCAGAGCUUUGga-3'       (SEQ ID NO: 618)
                     3'-CCCACUUCUUAAUGAGUCUCGAAACCU-5'     (SEQ ID NO: 240)

HIF-1α-2872  Target: 5'-GGGTGAAGAATTACTCAGAGCTTTGGA-3'     (SEQ ID NO: 996)

5'-GAAGAAUUACUCAGAGCUUUGGAtc-3'       (SEQ ID NO: 619)
                     3'-CACUUCUUAAUGAGUCUCGAAACCUAG-5'     (SEQ ID NO: 241)

HIF-1α-2874  Target: 5'-GTGAAGAATTACTCAGAGCTTTGGATC-3'     (SEQ ID NO: 997)

5'-AGAAUUACUCAGAGCUUUGGAUCaa-3'       (SEQ ID NO: 620)
                     3'-CUUCUUAAUGAGUCUCGAAACCUAGUU-5'     (SEQ ID NO: 242)

HIF-1α-2876  Target: 5'-GAAGAATTACTCAGAGCTTTGGATCAA-3'     (SEQ ID NO: 998)

5'-AAUUACUCAGAGCUUUGGAUCAAgt-3'       (SEQ ID NO: 621)
                     3'-UCUUAAUGAGUCUCGAAACCUAGUUCA-5'     (SEQ ID NO: 243)

HIF-1α-2878  Target: 5'-AGAATTACTCAGAGCTTTGGATCAAGT-3'     (SEQ ID NO: 999)

5'-UUACUCAGAGCUUUGGAUCAAGUta-3'       (SEQ ID NO: 622)
                     3'-UUAAUGAGUCUCGAAACCUAGUUCAAU-5'     (SEQ ID NO: 244)

HIF-1α-2880  Target: 5'-AATTACTCAGAGCTTTGGATCAAGTTA-3'     (SEQ ID NO: 1000)

5'-ACUCAGAGCUUUGGAUCAAGUUAac-3'       (SEQ ID NO: 623)
                     3'-AAUGAGUCUCGAAACCUAGUUCAAUUG-5'     (SEQ ID NO: 245)

HIF-1α-2882  Target: 5'-TTACTCAGAGCTTTGGATCAAGTTAAC-3'     (SEQ ID NO: 1001)

5'-UCAGAGCUUUGGAUCAAGUUAACtg-3'       (SEQ ID NO: 624)
                     3'-UGAGUCUCGAAACCUAGUUCAAUUGAC-5'     (SEQ ID NO: 246)

HIF-1α-2884  Target: 5'-ACTCAGAGCTTTGGATCAAGTTAACTG-3'     (SEQ ID NO: 1002)

5'-AGAGCUUUGGAUCAAGUUAACUGag-3'       (SEQ ID NO: 625)
                     3'-AGUCUCGAAACCUAGUUCAAUUGACUC-5'     (SEQ ID NO: 247)

HIF-1α-2886  Target: 5'-TCAGAGCTTTGGATCAAGTTAACTGAG-3'     (SEQ ID NO: 1003)

5'-AGCUUUGGAUCAAGUUAACUGAGct-3'       (SEQ ID NO: 626)
                     3'-UCUCGAAACCUAGUUCAAUUGACUCGA-5'     (SEQ ID NO: 248)
```

TABLE 2-continued

Selected Anti-HIF-1α DsiRNA Agents (Asymmetrics, HIF-1α)

```
HIF-1α-2888  Target: 5'-AGAGCTTTGGATCAAGTTAACTGAGCT-3'      (SEQ ID NO: 1004)

5'-CUUUGGAUCAAGUUAACUGAGCUtt-3'        (SEQ ID NO: 627)
                     3'-UCGAAACCUAGUUCAAUUGACUCGAAA-5'      (SEQ ID NO: 249)

HIF-1α-2890  Target: 5'-AGCTTTGGATCAAGTTAACTGAGCTTT-3'      (SEQ ID NO: 1005)

5'-UUGGAUCAAGUUAACUGAGCUUUtt-3'        (SEQ ID NO: 628)
                     3'-GAAACCUAGUUCAAUUGACUCGAAAAA-5'      (SEQ ID NO: 250)

HIF-1α-2892  Target: 5'-CTTTGGATCAAGTTAACTGAGCTTTTT-3'      (SEQ ID NO: 1006)

5'-GAUCAAGUUAACUGAGCUUUUUCtt-3'        (SEQ ID NO: 629)
                     3'-ACCUAGUUCAAUUGACUCGAAAAAGAA-5'      (SEQ ID NO: 251)

HIF-1α-2895  Target: 5'-TGGATCAAGTTAACTGAGCTTTTTCTT-3'      (SEQ ID NO: 1007)

5'-CUGAGCUUUUUCUUAAUUUCAUUcc-3'        (SEQ ID NO: 630)
                     3'-UUGACUCGAAAAAGAAUUAAAGUAAGG-5'      (SEQ ID NO: 252)

HIF-1α-2906  Target: 5'-AACTGAGCTTTTTCTTAATTTCATTCC-3'      (SEQ ID NO: 1008)

5'-GCUUUUUCUUAAUUUCAUUCCUUtt-3'        (SEQ ID NO: 631)
                     3'-CUCGAAAAAGAAUUAAAGUAAGGAAAA-5'      (SEQ ID NO: 253)

HIF-1α-2910  Target: 5'-GAGCTTTTTCTTAATTTCATTCCTTTT-3'      (SEQ ID NO: 1009)

5'-UAAUUUCAUUCCUUUUUUUGGACac-3'        (SEQ ID NO: 632)
                     3'-GAAUUAAAGUAAGGAAAAAAACCUGUG-5'      (SEQ ID NO: 254)

HIF-1α-2919  Target: 5'-CTTAATTTCATTCCTTTTTTTGGACAC-3'      (SEQ ID NO: 1010)

5'-CAUUCCUUUUUUUGGACACUGGUgg-3'        (SEQ ID NO: 633)
                     3'-AGUAAGGAAAAAAACCUGUGACCACC-5'       (SEQ ID NO: 255)

HIF-1α-2925  Target: 5'-TTCATTCCTTTTTTTGGACACTGGTGG-3'      (SEQ ID NO: 1011)

5'-UUUUUGGACACUGGUGGCUCAUUac-3'        (SEQ ID NO: 634)
                     3'-AAAAAAACCUGUGACCACCGAGUAAUG-5'      (SEQ ID NO: 256)

HIF-1α-2933  Target: 5'-TTTTTTTGGACACTGGTGGCTCATTAC-3'      (SEQ ID NO: 1012)

5'-UUUGGACACUGGUGGCUCAUUACct-3'        (SEQ ID NO: 635)
                     3'-AAAAACCUGUGACCACCGAGUAAUGGA-5'      (SEQ ID NO: 257)

HIF-1α-2935  Target: 5'-TTTTTGGACACTGGTGGCTCATTACCT-3'      (SEQ ID NO: 1013)

5'-GCAGUCUAUUUAUAUUUUCUACAUc-3'        (SEQ ID NO: 636)
                     3'-UUCGUCAGAUAAAUAUAAAAGAUGUAG-5'      (SEQ ID NO: 258)

HIF-1α-2963  Target: 5'-AAGCAGTCTATTTATATTTTCTACATC-3'      (SEQ ID NO: 1014)

5'-AGUCUAUUUAUAUUUUCUACAUCta-3'        (SEQ ID NO: 637)
                     3'-CGUCAGAUAAAUAUAAAAGAUGUAGAU-5'      (SEQ ID NO: 259)

HIF-1α-2965  Target: 5'-GCAGTCTATTTATATTTTCTACATCTA-3'      (SEQ ID NO: 1015)

5'-AUUUAUAUUUUCUACAUCUAAUUtt-3'        (SEQ ID NO: 638)
                     3'-GAUAAAUAUAAAAGAUGUAGAUUAAAA-5'      (SEQ ID NO: 260)

HIF-1α-2970  Target: 5'-CTATTTATATTTTCTACATCTAATTTT-3'      (SEQ ID NO: 1016)

5'-UCUAAUUUUAGAAGCCUGGCUACaa-3'        (SEQ ID NO: 639)
                     3'-GUAGAUUAAAAUCUUCGGACCGAUGUU-5'      (SEQ ID NO: 261)

HIF-1α-2986  Target: 5'-CATCTAATTTTAGAAGCCTGGCTACAA-3'      (SEQ ID NO: 1017)

5'-UAAUUUUAGAAGCCUGGCUACAAta-3'        (SEQ ID NO: 640)
                     3'-AGAUUAAAAUCUUCGGACCGAUGUUAU-5'      (SEQ ID NO: 262)

HIF-1α-2988  Target: 5'-TCTAATTTTAGAAGCCTGGCTACAATA-3'      (SEQ ID NO: 1018)

5'-AUUUUAGAAGCCUGGCUACAAUAct-3'        (SEQ ID NO: 641)
                     3'-AUUAAAAUCUUCGGACCGAUGUUAUGA-5'      (SEQ ID NO: 263)
```

TABLE 2-continued

Selected Anti-HIF-1α DsiRNA Agents (Asymmetrics, HIF-1α)

```
HIF-1α-2990  Target: 5'-TAATTTTAGAAGCCTGGCTACAATACT-3'      (SEQ ID NO: 1019)

5'-UUUAGAAGCCUGGCUACAAUACUgc-3'        (SEQ ID NO: 642)
                     3'-UAAAAUCUUCGGACCGAUGUUAUGACG-5'      (SEQ ID NO: 264)

HIF-1α-2992  Target: 5'-ATTTTAGAAGCCTGGCTACAATACTGC-3'      (SEQ ID NO: 1020)

5'-UAGAAGCCUGGCUACAAUACUGCac-3'        (SEQ ID NO: 643)
                     3'-AAAUCUUCGGACCGAUGUUAUGACGUG-5'      (SEQ ID NO: 265)

HIF-1α-2994  Target: 5'-TTTAGAAGCCTGGCTACAATACTGCAC-3'      (SEQ ID NO: 1021)

5'-GAAGCCUGGCUACAAUACUGCACaa-3'        (SEQ ID NO: 644)
                     3'-AUCUUCGGACCGAUGUUAUGACGUGUU-5'      (SEQ ID NO: 266)

HIF-1α-2996  Target: 5'-TAGAAGCCTGGCTACAATACTGCACAA-3'      (SEQ ID NO: 1022)

5'-AGCCUGGCUACAAUACUGCACAAac-3'        (SEQ ID NO: 645)
                     3'-CUUCGGACCGAUGUUAUGACGUGUUUG-5'      (SEQ ID NO: 267)

HIF-1α-2998  Target: 5'-GAAGCCTGGCTACAATACTGCACAAAC-3'      (SEQ ID NO: 1023)

5'-CCUGGCUACAAUACUGCACAAACtt-3'        (SEQ ID NO: 646)
                     3'-UCGGACCGAUGUUAUGACGUGUUUGAA-5'      (SEQ ID NO: 268)

HIF-1α-3000  Target: 5'-AGCCTGGCTACAATACTGCACAAACTT-3'      (SEQ ID NO: 1024)

5'-UGGCUACAAUACUGCACAAACUUgg-3'        (SEQ ID NO: 647)
                     3'-GGACCGAUGUUAUGACGUGUUUGAACC-5'      (SEQ ID NO: 269)

HIF-1α-3002  Target: 5'-CCTGGCTACAATACTGCACAAACTTGG-3'      (SEQ ID NO: 1025)

5'-GCUACAAUACUGCACAAACUUGGtt-3'        (SEQ ID NO: 648)
                     3'-ACCGAUGUUAUGACGUGUUUGAACCAA-5'      (SEQ ID NO: 270)

HIF-1α-3004  Target: 5'-TGGCTACAATACTGCACAAACTTGGTT-3'      (SEQ ID NO: 1026)

5'-UAAUUUACAUUAAUGCUCUUUUUUta-3'       (SEQ ID NO: 649)
                     3'-GAAUUAAAUGUAAUUACGAGAAAAAAU-5'      (SEQ ID NO: 271)

HIF-1α-3055  Target: 5'-CTTAATTTACATTAATGCTCTTTTTTA-3'      (SEQ ID NO: 1027)

5'-UAAUGCUCUUUUUUAGUAUGUUCtt-3'        (SEQ ID NO: 650)
                     3'-UAAUUACGAGAAAAAAUCAUACAAGAA-5'      (SEQ ID NO: 272)

HIF-1α-3065  Target: 5'-ATTAATGCTCTTTTTTAGTATGTTCTT-3'      (SEQ ID NO: 1028)

5'-AUGCUCUUUUUUAGUAUGUUCUUta-3'        (SEQ ID NO: 651)
                     3'-AUUACGAGAAAAAAUCAUACAAGAAAU-5'      (SEQ ID NO: 273)

HIF-1α-3067  Target: 5'-TAATGCTCTTTTTTAGTATGTTCTTTA-3'      (SEQ ID NO: 1029)

5'-UGCUCUUUUUUAGUAUGUUCUUUaa-3'        (SEQ ID NO: 652)
                     3'-UUACGAGAAAAAAUCAUACAAGAAAUU-5'      (SEQ ID NO: 274)

HIF-1α-3068  Target: 5'-AATGCTCTTTTTTAGTATGTTCTTTAA-3'      (SEQ ID NO: 1030)

5'-UUAGUAUGUUCUUUAAUGCUGGAtc-3'        (SEQ ID NO: 653)
                     3'-AAAUCAUACAAGAAAUUACGACCUAG-5'       (SEQ ID NO: 275)

HIF-1α-3077  Target: 5'-TTTTAGTATGTTCTTTAATGCTGGATC-3'      (SEQ ID NO: 1031)

5'-UAUGUUCUUUAAUGCUGGAUCACag-3'        (SEQ ID NO: 654)
                     3'-UCAUACAAGAAAUUACGACCUAGUGUC-5'      (SEQ ID NO: 276)

HIF-1α-3081  Target: 5'-AGTATGTTCTTTAATGCTGGATCACAG-3'      (SEQ ID NO: 1032)

5'-UUUAAUGCUGGAUCACAGACAGCtc-3'        (SEQ ID NO: 655)
                     3'-AGAAAUUACGACCUAGUGUCUGUCGAG-5'      (SEQ ID NO: 277)

HIF-1α-3088  Target: 5'-TCTTTAATGCTGGATCACAGACAGCTC-3'      (SEQ ID NO: 1033)

5'-UGCUGGAUCACAGACAGCUCAUUtt-3'        (SEQ ID NO: 656)
                     3'-UUACGACCUAGUGUCUGUCGAGUAAAA-5'      (SEQ ID NO: 278)
```

TABLE 2-continued

Selected Anti-HIF-1α DsiRNA Agents (Asymmetrics, HIF-1α)

```
HIF-1α-3093 Target: 5'-AATGCTGGATCACAGACAGCTCATTTT-3'    (SEQ ID NO: 1034)

5'-CUCAUUUUCUCAGUUUUUUGGUAtt-3'       (SEQ ID NO: 657)
                    3'-UCGAGUAAAAGAGUCAAAAAACCAUAA-5'     (SEQ ID NO: 279)

HIF-1α-3110 Target: 5'-AGCTCATTTTCTCAGTTTTTTGGTATT-3'    (SEQ ID NO: 1035)

5'-AAAAUGCACCUUUUUAUUUAUUUat-3'       (SEQ ID NO: 658)
                    3'-UUUUUUACGUGGAAAAAUAAAUAAAUA-5'     (SEQ ID NO: 280)

HIF-1α-3167 Target: 5'-AAAAAATGCACCTTTTTATTTATTTAT-3'    (SEQ ID NO: 1036)

5'-AAUGCACCUUUUUAUUUAUUUAUtt-3'       (SEQ ID NO: 659)
                    3'-UUUUACGUGGAAAAAUAAAUAAAUAAA-5'     (SEQ ID NO: 281)

HIF-1α-3169 Target: 5'-AAAATGCACCTTTTTATTTATTTATTT-3'    (SEQ ID NO: 1037)

5'-UGCACCUUUUUAUUUAUUUAUUUtt-3'       (SEQ ID NO: 660)
                    3'-UUACGUGGAAAAAUAAAUAAAUAAAAA-5'     (SEQ ID NO: 282)

HIF-1α-3171 Target: 5'-AATGCACCTTTTTATTTATTTATTTTT-3'    (SEQ ID NO: 1038)

5'-CACCUUUUUAUUUAUUUAUUUUUgg-3'       (SEQ ID NO: 661)
                    3'-ACGUGGAAAAAUAAAUAAAUAAAAACC-5'     (SEQ ID NO: 283)

HIF-1α-3173 Target: 5'-TGCACCTTTTTATTTATTTATTTTGG-3'     (SEQ ID NO: 1039)

5'-CCUUUUUAUUUAUUUAUUUUUGGct-3'       (SEQ ID NO: 662)
                    3'-GUGGAAAAAUAAAUAAAUAAAAACCGA-5'     (SEQ ID NO: 284)

HIF-1α-3175 Target: 5'-CACCTTTTTATTTATTTATTTTGGCT-3'     (SEQ ID NO: 1040)

5'-UUUUUAUUUAUUUAUUUUUGGCUag-3'       (SEQ ID NO: 663)
                    3'-GGAAAAAUAAAUAAAUAAAAACCGAUC-5'     (SEQ ID NO: 285)

HIF-1α-3177 Target: 5'-CCTTTTTATTTATTTATTTTGGCTAG-3'     (SEQ ID NO: 1041)

5'-UUUAUUUAUUUAUUUUUGGCUAGgg-3'       (SEQ ID NO: 664)
                    3'-AAAAUAAAUAAAUAAAAACCGAUCCC-5'      (SEQ ID NO: 286)

HIF-1α-3179 Target: 5'-TTTTTATTTATTTATTTTGGCTAGGG-3'     (SEQ ID NO: 1042)

5'-UUUUCGAAUUAUUUUUAAGAAGAtg-3'       (SEQ ID NO: 665)
                    3'-GAAAAAGCUUAAUAAAAAUUCUUCUAC-5'     (SEQ ID NO: 287)

HIF-1α-3215 Target: 5'-CTTTTTCGAATTATTTTTAAGAAGATG-3'    (SEQ ID NO: 1043)

5'-CAAUAUAAUUUUGUAAGAAGGCag-3'        (SEQ ID NO: 666)
                    3'-CGGUUAUAUUAAAAACAUUCUUCCGUC-5'     (SEQ ID NO: 288)

HIF-1α-3241 Target: 5'-GCCAATATAATTTTTGTAAGAAGGCAG-3'    (SEQ ID NO: 1044)

5'-CAUCAUGAUCAUAGGCAGUUGAAaa-3'       (SEQ ID NO: 667)
                    3'-AAGUAGUACUAGUAUCCGUCAACUUUU-5'     (SEQ ID NO: 289)

HIF-1α-3274 Target: 5'-TTCATCATGATCATAGGCAGTTGAAAA-3'    (SEQ ID NO: 1045)

5'-UCAUGAUCAUAGGCAGUUGAAAAat-3'       (SEQ ID NO: 668)
                    3'-GUAGUACUAGUAUCCGUCAACUUUUUA-5'     (SEQ ID NO: 290)

HIF-1α-3276 Target: 5'-CATCATGATCATAGGCAGTTGAAAAAT-3'    (SEQ ID NO: 1046)

5'-AUGAUCAUAGGCAGUUGAAAAAUtt-3'       (SEQ ID NO: 669)
                    3'-AGUACUAGUAUCCGUCAACUUUUUAAA-5'     (SEQ ID NO: 291)

HIF-1α-3278 Target: 5'-TCATGATCATAGGCAGTTGAAAAATTT-3'    (SEQ ID NO: 1047)

5'-GAUCAUAGGCAGUUGAAAAAUUUtt-3'       (SEQ ID NO: 670)
                    3'-UACUAGUAUCCGUCAACUUUUUAAAAA-5'     (SEQ ID NO: 292)

HIF-1α-3280 Target: 5'-ATGATCATAGGCAGTTGAAAAATTTTT-3'    (SEQ ID NO: 1048)

5'-UUGAAAAAUUUUUACACCUUUUUtt-3'       (SEQ ID NO: 671)
                    3'-UCAACUUUUUAAAAAUGUGGAAAAAAA-5'     (SEQ ID NO: 293)
```

TABLE 2-continued

Selected Anti-HIF-1α DsiRNA Agents (Asymmetrics, HIF-1α)

```
HIF-1α-3292  Target: 5'-AGTTGAAAAATTTTTACACCTTTTTTT-3'      (SEQ ID NO: 1049)

5'-UUUUUUUUCACAUUUUACAUAAAta-3'        (SEQ ID NO: 672)
                     3'-GGAAAAAAAAGUGUAAAAUGUAUUUAU-5'      (SEQ ID NO: 294)

HIF-1α-3310  Target: 5'-CCTTTTTTTTCACATTTTACATAAATA-3'      (SEQ ID NO: 1050)

5'-GGUAGCCACAAUUGCACAAUAUAUtt-3'       (SEQ ID NO: 673)
                     3'-CACCAUCGGUGUUAACGUGUUAUAUAA-5'      (SEQ ID NO: 295)

HIF-1α-3358  Target: 5'-GTGGTAGCCACAATTGCACAATATATT-3'      (SEQ ID NO: 1051)

5'-UAGCCACAAUUGCACAAUAUAUUtt-3'        (SEQ ID NO: 674)
                     3'-CCAUCGGUGUUAACGUGUUAUAUAAAA-5'      (SEQ ID NO: 296)

HIF-1α-3360  Target: 5'-GGTAGCCACAATTGCACAATATATTTT-3'      (SEQ ID NO: 1052)

5'-GCCACAAUUGCACAAUAUAUUUCct-3'        (SEQ ID NO: 675)
                     3'-AUCGGUGUUAACGUGUUAUAUAAAGA-5'       (SEQ ID NO: 297)

HIF-1α-3362  Target: 5'-TAGCCACAATTGCACAATATATTTTCT-3'      (SEQ ID NO: 1053)

5'-CACAAUUGCACAAUAUAUUUUCUta-3'        (SEQ ID NO: 676)
                     3'-CGGUGUUAACGUGUUAUAUAAAAGAAU-5'      (SEQ ID NO: 298)

HIF-1α-3364  Target: 5'-GCCACAATTGCACAATATATTTTCTTA-3'      (SEQ ID NO: 1054)

5'-CAAUUGCACAAUAUAUUUUCUUAaa-3'        (SEQ ID NO: 677)
                     3'-GUGUUAACGUGUUAUAUAAAGAAUUU-5'       (SEQ ID NO: 299)

HIF-1α-3366  Target: 5'-CACAATTGCACAATATATTTTCTTAAA-3'      (SEQ ID NO: 1055)

5'-AUUGCACAAUAUAUUUUCUUAAAaa-3'        (SEQ ID NO: 678)
                     3'-GUUAACGUGUUAUAUAAAGAAUUUUU-5'       (SEQ ID NO: 300)

HIF-1α-3368  Target: 5'-CAATTGCACAATATATTTTCTTAAAAA-3'      (SEQ ID NO: 1056)

5'-CAAUAUAUUUUCUUAAAAAAUACca-3'        (SEQ ID NO: 679)
                     3'-GUGUUAUAUAAAGAAUUUUUUAUGGU-5'       (SEQ ID NO: 301)

HIF-1α-3374  Target: 5'-CACAATATATTTTCTTAAAAAATACCA-3'      (SEQ ID NO: 1057)

5'-GUUUAUAAAACUAGUUUUUAAGAag-3'        (SEQ ID NO: 680)
                     3'-CGCAAAUAUUUUGAUCAAAAAUUCUUC-5'      (SEQ ID NO: 302)

HIF-1α-3425  Target: 5'-GCGTTTATAAAACTAGTTTTTAAGAAG-3'      (SEQ ID NO: 1058)

5'-UUUAUAAAACUAGUUUUUAAGAAga-3'        (SEQ ID NO: 681)
                     3'-GCAAAUAUUUUGAUCAAAAAUUCUUCU-5'      (SEQ ID NO: 303)

HIF-1α-3426  Target: 5'-CGTTTATAAAACTAGTTTTTAAGAAGA-3'      (SEQ ID NO: 1059)

5'-UAUAAAACUAGUUUUUAAGAAGAaa-3'        (SEQ ID NO: 682)
                     3'-AAAUAUUUUGAUCAAAAAUUCUUCUUU-5'      (SEQ ID NO: 304)

HIF-1α-3428  Target: 5'-TTTATAAAACTAGTTTTTAAGAAGAAA-3'      (SEQ ID NO: 1060)

5'-UAAAACUAGUUUUUAAGAAGAAAtt-3'        (SEQ ID NO: 683)
                     3'-AUAUUUUGAUCAAAAAUUCUUCUUUAA-5'      (SEQ ID NO: 305)

HIF-1α-3430  Target: 5'-TATAAAACTAGTTTTTAAGAAGAAATT-3'      (SEQ ID NO: 1061)

5'-UUAAGAAGAAAUUUUUUUGGCCta-3'         (SEQ ID NO: 684)
                     3'-AAAUUCUUCUUUAAAAAAACCGGAU-5'        (SEQ ID NO: 306)

HIF-1α-3442  Target: 5'-TTTTAAGAAGAAATTTTTTTGGCCTA-3'       (SEQ ID NO: 1062)

5'-AGAAAUUUUUUUGGCCUAUGAAat-3'         (SEQ ID NO: 685)
                     3'-CUUCUUUAAAAAAACCGGAUACUUUA-5'       (SEQ ID NO: 307)

HIF-1α-3448  Target: 5'-GAAGAAATTTTTTTTGGCCTATGAAAT-3'      (SEQ ID NO: 1063)

5'-AAAUUUUUUUUGGCCUAUGAAAUtg-3'        (SEQ ID NO: 686)
                     3'-UCUUUAAAAAAACCGGAUACUUUAAC-5'       (SEQ ID NO: 308)
```

TABLE 2-continued

Selected Anti-HIF-1α DsiRNA Agents (Asymmetrics, HIF-1α)

```
HIF-1α-3450  Target: 5'-AGAAATTTTTTTGGCCTATGAAATTG-3'     (SEQ ID NO: 1064)

5'-UAUGAAAUUGUUAAACCUGGAACat-3'      (SEQ ID NO: 687)
                     3'-GGAUACUUUAACAAUUUGGACCUUGUA-5'    (SEQ ID NO: 309)

HIF-1α-3465  Target: 5'-CCTATGAAATTGTTAAACCTGGAACAT-3'    (SEQ ID NO: 1065)

5'-AUUGUUAAUCAUAUAAUAAUGAUtc-3'      (SEQ ID NO: 688)
                     3'-UGUAACAAUUAGUAUAUUAUUACUAAG-5'    (SEQ ID NO: 310)

HIF-1α-3493  Target: 5'-ACATTGTTAATCATATAATAATGATTC-3'    (SEQ ID NO: 1066)

5'-AUGGUUUAUUAUUUAAAUGGGUAaa-3'      (SEQ ID NO: 689)
                     3'-CAUACCAAAUAAUAAAUUUACCCAUUU-5'    (SEQ ID NO: 311)

HIF-1α-3529  Target: 5'-GTATGGTTTATTATTTAAATGGGTAAA-3'    (SEQ ID NO: 1067)

5'-UGGGUAAAGCCAUUUACAUAAUAta-3'      (SEQ ID NO: 690)
                     3'-UUACCCAUUUCGGUAAAUGUAUUAUAU-5'    (SEQ ID NO: 312)

HIF-1α-3546  Target: 5'-AATGGGTAAAGCCATTTACATAATATA-3'    (SEQ ID NO: 1068)

5'-AUUUACAUAAUAUAGAAAGAUAUgc-3'      (SEQ ID NO: 691)
                     3'-GGUAAAUGUAUUAUAUCUUUCUAUACG-5'    (SEQ ID NO: 313)

HIF-1α-3557  Target: 5'-CCATTTACATAATATAGAAAGATATGC-3'    (SEQ ID NO: 1069)

5'-AAGGUAUGUGGCAUUUAUUUGGAta-3'      (SEQ ID NO: 692)
                     3'-UCUUCCAUACACCGUAAAUAAACCUAU-5'    (SEQ ID NO: 314)

HIF-1α-3592  Target: 5'-AGAAGGTATGTGGCATTTATTTGGATA-3'    (SEQ ID NO: 1070)

5'-GGUAUGUGGCAUUUAUUUGGAUAaa-3'      (SEQ ID NO: 693)
                     3'-UUCCAUACACCGUAAAUAAACCUAUUU-5'    (SEQ ID NO: 315)

HIF-1α-3594  Target: 5'-AAGGTATGTGGCATTTATTTGGATAAA-3'    (SEQ ID NO: 1071)

5'-UAUGUGGCAUUUAUUUGGAUAAAat-3'      (SEQ ID NO: 694)
                     3'-CCAUACACCGUAAAUAAACCUAUUUA-5'     (SEQ ID NO: 316)

HIF-1α-3596  Target: 5'-GGTATGTGGCATTTATTTGGATAAAAT-3'    (SEQ ID NO: 1072)

5'-UGUGGCAUUUAUUUGGAUAAAAUtc-3'      (SEQ ID NO: 695)
                     3'-AUACACCGUAAAUAAACCUAUUUUAAG-5'    (SEQ ID NO: 317)

HIF-1α-3598  Target: 5'-TATGTGGCATTTATTTGGATAAAATTC-3'    (SEQ ID NO: 1073)

5'-UGGCAUUUAUUUGGAUAAAAUUCtc-3'      (SEQ ID NO: 696)
                     3'-ACACCGUAAAUAAACCUAUUUUAAGAG-5'    (SEQ ID NO: 318)

HIF-1α-3600  Target: 5'-TGTGGCATTTATTTGGATAAAATTCTC-3'    (SEQ ID NO: 1074)

5'-GCAUUUAUUUGGAUAAAAUUCUCaa-3'      (SEQ ID NO: 697)
                     3'-ACCGUAAAUAAACCUAUUUUAAGAGUU-5'    (SEQ ID NO: 319)

HIF-1α-3602  Target: 5'-TGGCATTTATTTGGATAAAATTCTCAA-3'    (SEQ ID NO: 1075)

5'-AUUUAUUUGGAUAAAAUUCUCAAtt-3'      (SEQ ID NO: 698)
                     3'-CGUAAAUAAACCUAUUUUAAGAGUUAA-5'    (SEQ ID NO: 320)

HIF-1α-3604  Target: 5'-GCATTTATTTGGATAAAATTCTCAATT-3'    (SEQ ID NO: 1076)

5'-UUAUUUGGAUAAAAUUCUCAAUUca-3'      (SEQ ID NO: 699)
                     3'-UAAAUAAACCUAUUUUAAGAGUUAAGU-5'    (SEQ ID NO: 321)

HIF-1α-3606  Target: 5'-ATTTATTTGGATAAAATTCTCAATTCA-3'    (SEQ ID NO: 1077)

5'-AUUUGGAUAAAAUUCUCAAUUCAga-3'      (SEQ ID NO: 700)
                     3'-AAUAAACCUAUUUUAAGAGUUAAGUCU-5'    (SEQ ID NO: 322)

HIF-1α-3608  Target: 5'-TTATTTGGATAAAATTCTCAATTCAGA-3'    (SEQ ID NO: 1078)

5'-AUUUGGAUAAAAUUCUCAAUUCAga-3'      (SEQ ID NO: 701)
                     3'-AAUAAACCUAUUUUAAGAGUUAAGUCU-5'    (SEQ ID NO: 323)
```

TABLE 2-continued

Selected Anti-HIF-1α DsiRNA Agents (Asymmetrics, HIF-1α)

```
HIF-1α-3608  Target: 5'-TTATTTGGATAAAATTCTCAATTCAGA-3'        (SEQ ID NO: 1079)

5'-UUGGAUAAAAUUCUCAAUUCAGAga-3'           (SEQ ID NO: 702)
                    3'-UAAACCUAUUUUAAGAGUUAAGUCUCU-5'         (SEQ ID NO: 324)

HIF-1α-3610  Target: 5'-ATTTGGATAAAATTCTCAATTCAGAGA-3'        (SEQ ID NO: 1080)

5'-GGAUAAAAUUCUCAAUUCAGAGAaa-3'           (SEQ ID NO: 703)
                    3'-AACCUAUUUUAAGAGUUAAGUCUCUUU-5'         (SEQ ID NO: 325)

HIF-1α-3612  Target: 5'-TTGGATAAAATTCTCAATTCAGAGAAA-3'        (SEQ ID NO: 1081)

5'-AUAAAAUUCUCAAUUCAGAGAAAtc-3'           (SEQ ID NO: 704)
                    3'-CCUAUUUUAAGAGUUAAGUCUCUUUAG-5'         (SEQ ID NO: 326)

HIF-1α-3614  Target: 5'-GGATAAAATTCTCAATTCAGAGAAATC-3'        (SEQ ID NO: 1082)

5'-AAAAUUCUCAAUUCAGAGAAAUCat-3'           (SEQ ID NO: 705)
                    3'-UAUUUUAAGAGUUAAGUCUCUUUAGUA-5'         (SEQ ID NO: 327)

HIF-1α-3616  Target: 5'-ATAAAATTCTCAATTCAGAGAAATCAT-3'        (SEQ ID NO: 1083)

5'-UCUGAUGUUUCUAUAGUCACUUUgc-3'           (SEQ ID NO: 706)
                    3'-GUAGACUACAAAGAUAUCAGUGAAACG-5'         (SEQ ID NO: 328)

HIF-1α-3640  Target: 5'-CATCTGATGTTTCTATAGTCACTTTGC-3'        (SEQ ID NO: 1084)

5'-GUUUCUAUAGUCACUUUGCCAGCtc-3'           (SEQ ID NO: 707)
                    3'-UACAAAGAUAUCAGUGAAACGGUCGAG-5'         (SEQ ID NO: 329)

HIF-1α-3646  Target: 5'-ATGTTTCTATAGTCACTTTGCCAGCTC-3'        (SEQ ID NO: 1085)

5'-UAUAGUCACUUUGCCAGCUCAAAag-3'           (SEQ ID NO: 708)
                    3'-AGAUAUCAGUGAAACGGUCGAGUUUUC-5'         (SEQ ID NO: 330)

HIF-1α-3651  Target: 5'-TCTATAGTCACTTTGCCAGCTCAAAAG-3'        (SEQ ID NO: 1086)

5'-CAAAAGAAAACAAUACCCUAUGUag-3'           (SEQ ID NO: 709)
                    3'-GAGUUUUCUUUUGUUAUGGGAUACAUC-5'         (SEQ ID NO: 331)

HIF-1α-3670  Target: 5'-CTCAAAAGAAAACAATACCCTATGTAG-3'        (SEQ ID NO: 1087)

5'-UUCUGCCUACCCUGUUGGUAUAAag-3'           (SEQ ID NO: 710)
                    3'-ACAAGACGGAUGGGACAACCAUAUUUC-5'         (SEQ ID NO: 332)

HIF-1α-3743  Target: 5'-TGTTCTGCCTACCCTGTTGGTATAAAG-3'        (SEQ ID NO: 1088)

5'-CUGCCUACCCUGUUGGUAUAAAGat-3'           (SEQ ID NO: 711)
                    3'-AAGACGGAUGGGACAACCAUAUUUCUA-5'         (SEQ ID NO: 333)

HIF-1α-3745  Target: 5'-TTCTGCCTACCCTGTTGGTATAAAGAT-3'        (SEQ ID NO: 1089)

5'-UGCCUACCCUGUUGGUAUAAAGAta-3'           (SEQ ID NO: 712)
                    3'-AGACGGAUGGGACAACCAUAUUUCUAU-5'         (SEQ ID NO: 334)

HIF-1α-3746  Target: 5'-TCTGCCTACCCTGTTGGTATAAAGATA-3'        (SEQ ID NO: 1090)

5'-CCUACCCUGUUGGUAUAAAGAUAtt-3'           (SEQ ID NO: 713)
                    3'-ACGGAUGGGACAACCAUAUUUCUAUAA-5'         (SEQ ID NO: 335)

HIF-1α-3748  Target: 5'-TGCCTACCCTGTTGGTATAAAGATATT-3'        (SEQ ID NO: 1091)

5'-CUACCCUGUUGGUAUAAAGAUAUtt-3'           (SEQ ID NO: 714)
                    3'-CGGAUGGGACAACCAUAUUUCUAUAAA-5'         (SEQ ID NO: 336)

HIF-1α-3749  Target: 5'-GCCTACCCTGTTGGTATAAAGATATTT-3'        (SEQ ID NO: 1092)

5'-CUGUUGGUAUAAAGAUAUUUUGAgc-3'           (SEQ ID NO: 715)
                    3'-GGGACAACCAUAUUUCUAUAAAACUCG-5'         (SEQ ID NO: 337)

HIF-1α-3754  Target: 5'-CCCTGTTGGTATAAAGATATTTTGAGC-3'        (SEQ ID NO: 1093)

5'-UUGGUAUAAAGAUAUUUUGAGCAga-3'           (SEQ ID NO: 716)
                    3'-ACAACCAUAUUUCUAUAAAACUCGUCU-5'         (SEQ ID NO: 338)
```

TABLE 2-continued

Selected Anti-HIF-1α DsiRNA Agents (Asymmetrics, HIF-1α)

```
HIF-1α-3757  Target: 5'-TGTTGGTATAAAGATATTTTGAGCAGA-3'      (SEQ ID NO: 1094)

5'-AGAAAAAAAAAAAUCAUGCAUUCUta-3'        (SEQ ID NO: 717)
                     3'-GUUCUUUUUUUUUUAGUACGUAAGAAU-5'       (SEQ ID NO: 339)

HIF-1α-3791  Target: 5'-CAAGAAAAAAAAAATCATGCATTCTTA-3'      (SEQ ID NO: 1095)

5'-UAUGUUAAUUUGCUCAAAAUACAat-3'         (SEQ ID NO: 718)
                     3'-UCAUACAAUUAAACGAGUUUUAUGUUA-5'       (SEQ ID NO: 340)

HIF-1α-3830  Target: 5'-AGTATGTTAATTTGCTCAAAATACAAT-3'      (SEQ ID NO: 1096)

5'-UUUUAUGCACUUUGUCGCUAUUAac-3'         (SEQ ID NO: 719)
                     3'-CUAAAAUACGUGAAACAGCGAUAAUUG-5'       (SEQ ID NO: 341)

HIF-1α-3861  Target: 5'-GATTTTATGCACTTTGTCGCTATTAAC-3'      (SEQ ID NO: 1097)

5'-UUAUGCACUUUGUCGCUAUUAACat-3'         (SEQ ID NO: 720)
                     3'-AAAAUACGUGAAACAGCGAUAAUUGUA-5'       (SEQ ID NO: 342)

HIF-1α-3863  Target: 5'-TTTTATGCACTTTGTCGCTATTAACAT-3'      (SEQ ID NO: 1098)

5'-AUGCACUUUGUCGCUAUUAACAUcc-3'         (SEQ ID NO: 721)
                     3'-AAUACGUGAAACAGCGAUAAUUGUAGG-5'       (SEQ ID NO: 343)

HIF-1α-3865  Target: 5'-TTATGCACTTTGTCGCTATTAACATCC-3'      (SEQ ID NO: 1099)

5'-GCACUUUGUCGCUAUUAACAUCCtt-3'         (SEQ ID NO: 722)
                     3'-UACGUGAAACAGCGAUAAUUGUAGGAA-5'       (SEQ ID NO: 344)

HIF-1α-3867  Target: 5'-ATGCACTTTGTCGCTATTAACATCCTT-3'      (SEQ ID NO: 1100)

5'-ACUUUGUCGCUAUUAACAUCCUUtt-3'         (SEQ ID NO: 723)
                     3'-CGUGAAACAGCGAUAAUUGUAGGAAAA-5'       (SEQ ID NO: 345)

HIF-1α-3869  Target: 5'-GCACTTTGTCGCTATTAACATCCTTTT-3'      (SEQ ID NO: 1101)

5'-UUUGUCGCUAUUAACAUCCUUUUtt-3'         (SEQ ID NO: 724)
                     3'-UGAAACAGCGAUAAUUGUAGGAAAAAA-5'       (SEQ ID NO: 346)

HIF-1α-3871  Target: 5'-ACTTTGTCGCTATTAACATCCTTTTTT-3'      (SEQ ID NO: 1102)

5'-UGUCGCUAUUAACAUCCUUUUUUtc-3'         (SEQ ID NO: 725)
                     3'-AAACAGCGAUAAUUGUAGGAAAAAAG-5'        (SEQ ID NO: 347)

HIF-1α-3873  Target: 5'-TTTGTCGCTATTAACATCCTTTTTTTC-3'      (SEQ ID NO: 1103)

5'-UCGCUAUUAACAUCCUUUUUUCat-3'          (SEQ ID NO: 726)
                     3'-ACAGCGAUAAUUGUAGGAAAAAAGUA-5'        (SEQ ID NO: 348)

HIF-1α-3875  Target: 5'-TGTCGCTATTAACATCCTTTTTTTCAT-3'      (SEQ ID NO: 1104)

5'-GCUAUUAACAUCCUUUUUUUCAUgt-3'         (SEQ ID NO: 727)
                     3'-AGCGAUAAUUGUAGGAAAAAAAGUACA-5'       (SEQ ID NO: 349)

HIF-1α-3877  Target: 5'-TCGCTATTAACATCCTTTTTTTCATGT-3'      (SEQ ID NO: 1105)

5'-AUUAACAUCCUUUUUUUCAUGUAga-3'         (SEQ ID NO: 728)
                     3'-GAUAAUUGUAGGAAAAAAAGUACAUCU-5'       (SEQ ID NO: 350)

HIF-1α-3880  Target: 5'-CTATTAACATCCTTTTTTTCATGTAGA-3'      (SEQ ID NO: 1106)

5'-GAGUAAUUUUAGAAGCAUUAUUUta-3'         (SEQ ID NO: 729)
                     3'-AACUCAUUAAAAUCUUCGUAAUAAAAU-5'       (SEQ ID NO: 351)

HIF-1α-3916  Target: 5'-TTGAGTAATTTTAGAAGCATTATTTTA-3'      (SEQ ID NO: 1107)

5'-GUAAUUUUAGAAGCAUUAUUUUAgg-3'         (SEQ ID NO: 730)
                     3'-CUCAUUAAAAUCUUCGUAAUAAAAUCC-5'       (SEQ ID NO: 352)

HIF-1α-3918  Target: 5'-GAGTAATTTTAGAAGCATTATTTTAGG-3'      (SEQ ID NO: 1108)

5'-AAUUUUAGAAGCAUUAUUUUAGGaa-3'         (SEQ ID NO: 731)
                     3'-CAUUAAAAUCUUCGUAAUAAAAUCCUU-5'       (SEQ ID NO: 353)
```

TABLE 2-continued

Selected Anti-HIF-1α DsiRNA Agents (Asymmetrics, HIF-1α)

```
HIF-1α-3920  Target: 5'-GTAATTTTAGAAGCATTATTTTAGGAA-3'       (SEQ ID NO: 1109)

5'-UUUUAGAAGCAUUAUUUUAGGAAta-3'         (SEQ ID NO: 732)
                     3'-UUAAAAUCUUCGUAAUAAAAUCCUUAU-5'       (SEQ ID NO: 354)

HIF-1α-3922  Target: 5'-AATTTTAGAAGCATTATTTTAGGAATA-3'       (SEQ ID NO: 1110)

5'-UUAGAAGCAUUAUUUUAGGAAUAta-3'         (SEQ ID NO: 733)
                     3'-AAAAUCUUCGUAAUAAAAUCCUUAUAU-5'       (SEQ ID NO: 355)

HIF-1α-3924  Target: 5'-TTTTAGAAGCATTATTTTAGGAATATA-3'       (SEQ ID NO: 1111)

5'-AGAAGCAUUAUUUUAGGAAUAUAta-3'         (SEQ ID NO: 734)
                     3'-AAUCUUCGUAAUAAAAUCCUUAUAUAU-5'       (SEQ ID NO: 356)

HIF-1α-3926  Target: 5'-TTAGAAGCATTATTTTAGGAATATATA-3'       (SEQ ID NO: 1112)

5'-AAGCAUUAUUUUAGGAAUAUAUAgt-3'         (SEQ ID NO: 735)
                     3'-UCUUCGUAAUAAAAUCCUUAUAUAUCA-5'       (SEQ ID NO: 357)

HIF-1α-3928  Target: 5'-AGAAGCATTATTTTAGGAATATATAGT-3'       (SEQ ID NO: 1113)

5'-GCAUUAUUUUAGGAAUAUAUAGUtg-3'         (SEQ ID NO: 736)
                     3'-UUCGUAAUAAAAUCCUUAUAUAUCAAC-5'       (SEQ ID NO: 358)

HIF-1α-3930  Target: 5'-AAGCATTATTTTAGGAATATATAGTTG-3'       (SEQ ID NO: 1114)

5'-UAAAUAUCUUGUUUUUCUAUGUac-3'          (SEQ ID NO: 737)
                     3'-UCAUUUAUAGAACAAAAAGAUACAUG-5'        (SEQ ID NO: 359)

HIF-1α-3961  Target: 5'-AGTAAATATCTTGTTTTTCTATGTAC-3'        (SEQ ID NO: 1115)

5'-AUGUACAUUGUACAAAUUUUUCAtt-3'         (SEQ ID NO: 738)
                     3'-GAUACAUGUAACAUGUUUAAAAAGUAA-5'       (SEQ ID NO: 360)

HIF-1α-3980  Target: 5'-CTATGTACATTGTACAAATTTTTCATT-3'       (SEQ ID NO: 1116)

5'-UUCAUUCCUUUUGCUCUUUGUGGtt-3'         (SEQ ID NO: 739)
                     3'-AAAAGUAAGGAAAACGAGAAACACCAA-5'       (SEQ ID NO: 361)

HIF-1α-3999  Target: 5'-TTTTCATTCCTTTTGCTCTTTGTGGTT-3'       (SEQ ID NO: 1117)

5'-UCAUUCCUUUUGCUCUUUGUGGUtg-3'         (SEQ ID NO: 740)
                     3'-AAAGUAAGGAAAACGAGAAACACCAAC-5'       (SEQ ID NO: 362)

HIF-1α-4000  Target: 5'-TTTCATTCCTTTTGCTCTTTGTGGTTG-3'       (SEQ ID NO: 1118)

5'-CAUUCCUUUUGCUCUUUGUGGUUgg-3'         (SEQ ID NO: 741)
                     3'-AAGUAAGGAAAACGAGAAACACCAACC-5'       (SEQ ID NO: 363)

HIF-1α-4001  Target: 5'-TTCATTCCTTTTGCTCTTTGTGGTTGG-3'       (SEQ ID NO: 1119)

5'-UUCCUUUUGCUCUUUGUGGUUGGat-3'         (SEQ ID NO: 742)
                     3'-GUAAGGAAAACGAGAAACACCAACCUA-5'       (SEQ ID NO: 364)

HIF-1α-4003  Target: 5'-CATTCCTTTTGCTCTTTGTGGTTGGAT-3'       (SEQ ID NO: 1120)

5'-UCCUUUUGCUCUUUGUGGUUGGAtc-3'         (SEQ ID NO: 743)
                     3'-UAAGGAAAACGAGAAACACCAACCUAG-5'       (SEQ ID NO: 365)

HIF-1α-4004  Target: 5'-ATTCCTTTTGCTCTTTGTGGTTGGATC-3'       (SEQ ID NO: 1121)

5'-CCUUUUGCUCUUUGUGGUUGGAUct-3'         (SEQ ID NO: 744)
                     3'-AAGGAAAACGAGAAACACCAACCUAGA-5'       (SEQ ID NO: 366)

HIF-1α-4005  Target: 5'-TTCCTTTTGCTCTTTGTGGTTGGATCT-3'       (SEQ ID NO: 1122)

5'-CUUUUGCUCUUUGUGGUUGGAUCta-3'         (SEQ ID NO: 745)
                     3'-AGGAAAACGAGAAACACCAACCUAGAU-5'       (SEQ ID NO: 367)

HIF-1α-4006  Target: 5'-TCCTTTTGCTCTTTGTGGTTGGATCTA-3'       (SEQ ID NO: 1123)

5'-UUUUGCUCUUUGUGGUUGGAUCUaa-3'         (SEQ ID NO: 746)
                     3'-GGAAAACGAGAAACACCAACCUAGAUU-5'       (SEQ ID NO: 368)
```

TABLE 2-continued

Selected Anti-HIF-1α DsiRNA Agents (Asymmetrics, HIF-1α)

| | | |
|---|---|---|
| HIF-1α-4007 Target: | 5'-CCTTTTGCTCTTTGTGGTTGGATCTAA-3' | (SEQ ID NO: 1124) |
| | 5'-UUUGCUCUUUGUGGUUGGAUCUAac-3' | (SEQ ID NO: 747) |
| | 3'-<u>GAA</u>AACGAGAAACACCAACCUAGAUUG-5' | (SEQ ID NO: 369) |
| HIF-1α-4008 Target: | 5'-CTTTTGCTCTTTGTGGTTGGATCTAAC-3' | (SEQ ID NO: 1125) |
| | 5'-UUGCUCUUUGUGGUUGGAUCUAAca-3' | (SEQ ID NO: 748) |
| | 3'-<u>AAA</u>ACGAGAAACACCAACCUAGAUUGU-5' | (SEQ ID NO: 370) |
| HIF-1α-4009 Target: | 5'-TTTTGCTCTTTGTGGTTGGATCTAACA-3' | (SEQ ID NO: 1126) |
| | 5'-UGCUCUUUGUGGUUGGAUCUAACac-3' | (SEQ ID NO: 749) |
| | 3'-<u>AAA</u>CGAGAAACACCAACCUAGAUUGUG-5' | (SEQ ID NO: 371) |
| HIF-1α-4010 Target: | 5'-TTTGCTCTTTGTGGTTGGATCTAACAC-3' | (SEQ ID NO: 1127) |
| | 5'-CUCUUUGUGGUUGGAUCUAACACta-3' | (SEQ ID NO: 750) |
| | 3'-<u>ACG</u>AGAAACACCAACCUAGAUUGUGAU-5' | (SEQ ID NO: 372) |
| HIF-1α-4012 Target: | 5'-TGCTCTTTGTGGTTGGATCTAACACTA-3' | (SEQ ID NO: 1128) |
| | 5'-AUCAAAUAAACAUCUUCUGUGGAcc-3' | (SEQ ID NO: 751) |
| | 3'-<u>UGU</u>AGUUUAUUUGUAGAAGACACCUGG-5' | (SEQ ID NO: 373) |
| HIF-1α-4055 Target: | 5'-ACATCAAATAAACATCTTCTGTGGACC-3' | (SEQ ID NO: 1129) |
| | 5'-CAAAUAAACAUCUUCUGUGGACCag-3' | (SEQ ID NO: 752) |
| | 3'-<u>UAG</u>UUUAUUUGUAGAAGACACCUGGUC-5' | (SEQ ID NO: 374) |
| HIF-1α-4057 Target: | 5'-ATCAAATAAACATCTTCTGTGGACCAG-3' | (SEQ ID NO: 1130) |
| | 5'-AAUAAACAUCUUCUGUGGACCAGgc-3' | (SEQ ID NO: 753) |
| | 3'-<u>GUU</u>UAUUUGUAGAAGACACCUGGUCCG-5' | (SEQ ID NO: 375) |
| HIF-1α-4059 Target: | 5'-CAAATAAACATCTTCTGTGGACCAGGC-3' | (SEQ ID NO: 1131) |
| | 5'-UAAACAUCUUCUGUGGACCAGGCaa-3' | (SEQ ID NO: 754) |
| | 3'-<u>UUA</u>UUUGUAGAAGACACCUGGUCCGUU-5' | (SEQ ID NO: 376) |
| HIF-1α-4061 Target: | 5'-AATAAACATCTTCTGTGGACCAGGCAA-3' | (SEQ ID NO: 1132) |
| | 5'-AACAUCUUCUGUGGACCAGGCAAaa-3' | (SEQ ID NO: 755) |
| | 3'-<u>AUU</u>UGUAGAAGACACCUGGUCCGUUUU-5' | (SEQ ID NO: 377) |
| HIF-1α-4063 Target: | 5'-TAAACATCTTCTGTGGACCAGGCAAAA-3' | (SEQ ID NO: 1133) |
| | 5'-CAUCUUCUGUGGACCAGGCAAAAaa-3' | (SEQ ID NO: 756) |
| | 3'-<u>UUG</u>UAGAAGACACCUGGUCCGUUUUUU-5' | (SEQ ID NO: 378) |
| HIF-1α-4065 Target: | 5'-AACATCTTCTGTGGACCAGGCAAAAAA-3' | (SEQ ID NO: 1134) |
| | 5'-AGAUAAGUUCUGAACGUCGAAAAga-3' | (SEQ ID NO: 2620) |
| | 3'-<u>UUU</u>CUAUUCAAGACUUGCAGCUUUUCU-5' | (SEQ ID NO: 2096) |
| HIF-1α-463 Target: | 5'-AAAGATAAGTTCTGAACGTCGAAAAGA-3' | (SEQ ID NO: 3144) |
| | 5'-UAAGUUCUGAACGUCGAAAAGAAaa-3' | (SEQ ID NO: 2621) |
| | 3'-<u>CUA</u>UUCAAGACUUGCAGCUUUUCUUUU-5' | (SEQ ID NO: 2097) |
| HIF-1α-466 Target: | 5'-GATAAGTTCTGAACGTCGAAAAGAAAA-3' | (SEQ ID NO: 3145) |
| | 5'-AGUUCUGAACGUCGAAAAGAAAAgt-3' | (SEQ ID NO: 2622) |
| | 3'-<u>AUU</u>CAAGACUUGCAGCUUUUCUUUUCA-5' | (SEQ ID NO: 2098) |
| HIF-1α-468 Target: | 5'-TAAGTTCTGAACGTCGAAAAGAAAAGT-3' | (SEQ ID NO: 3146) |
| | 5'-CUGAACGUCGAAAAGAAAAGUCUcg-3' | (SEQ ID NO: 2623) |
| | 3'-<u>AAG</u>ACUUGCAGCUUUUCUUUUCAGAGC-5' | (SEQ ID NO: 2099) |
| HIF-1α-472 Target: | 5'-TTCTGAACGTCGAAAAGAAAAGTCTCG-3' | (SEQ ID NO: 3147) |
| | 5'-CGAAAAGAAAAGUCUCGAGAUGCag-3' | (SEQ ID NO: 2624) |
| | 3'-<u>CAG</u>CUUUUCUUUUCAGAGCUCUACGUC-5' | (SEQ ID NO: 2100) |

TABLE 2-continued

Selected Anti-HIF-1α DsiRNA Agents (Asymmetrics, HIF-1α)

```
HIF-1α-480 Target:   5'-GTCGAAAAGAAAAGTCTCGAGATGCAG-3'      (SEQ ID NO: 3148)

5'-GAAAAGAAAAGUCUCGAGAUGCAgc-3'        (SEQ ID NO: 2625)
                     3'-AGCUUUUCUUUUCAGAGCUCUACGUCG-5'      (SEQ ID NO: 2101)

HIF-1α-481 Target:   5'-TCGAAAAGAAAAGTCTCGAGATGCAGC-3'      (SEQ ID NO: 3149)

5'-CGAAGUAAAGAAUCUGAAGUUUUUtt-3'       (SEQ ID NO: 2626)
                     3'-CCGCUUCAUUUCUUAGACUUCAAAAAA-5'      (SEQ ID NO: 2102)

HIF-1α-516 Target:   5'-GGCGAAGTAAAGAATCTGAAGTTTTTT-3'      (SEQ ID NO: 3150)

5'-GAAGUAAAGAAUCUGAAGUUUUUta-3'        (SEQ ID NO: 2627)
                     3'-CGCUUCAUUUCUUAGACUUCAAAAAAU-5'      (SEQ ID NO: 2103)

HIF-1α-517 Target:   5'-GCGAAGTAAAGAATCTGAAGTTTTTTA-3'      (SEQ ID NO: 3151)

5'-AGUAAAGAAUCUGAAGUUUUUUAtg-3'        (SEQ ID NO: 2628)
                     3'-CUUCAUUUCUUAGACUUCAAAAAAUAC-5'      (SEQ ID NO: 2104)

HIF-1α-519 Target:   5'-GAAGTAAAGAATCTGAAGTTTTTTATG-3'      (SEQ ID NO: 3152)

5'-GUAAAGAAUCUGAAGUUUUUUAUga-3'        (SEQ ID NO: 2629)
                     3'-UUCAUUUCUUAGACUUCAAAAAAUACU-5'      (SEQ ID NO: 2105)

HIF-1α-520 Target:   5'-AAGTAAAGAATCTGAAGTTTTTTATGA-3'      (SEQ ID NO: 3153)

5'-AAAGAAUCUGAAGUUUUUUAUGAgc-3'        (SEQ ID NO: 2630)
                     3'-CAUUUCUUAGACUUCAAAAAAUACUCG-5'      (SEQ ID NO: 2106)

HIF-1α-522 Target:   5'-GTAAAGAATCTGAAGTTTTTTATGAGC-3'      (SEQ ID NO: 3154)

5'-CUGAAGUUUUUUAUGAGCUUGCUca-3'        (SEQ ID NO: 2631)
                     3'-UAGACUUCAAAAAAUACUCGAACGAGU-5'      (SEQ ID NO: 2107)

HIF-1α-529 Target:   5'-ATCTGAAGTTTTTTATGAGCTTGCTCA-3'      (SEQ ID NO: 3155)

5'-GUUGCCACUUCCACAUAAUGUGAgt-3'        (SEQ ID NO: 2632)
                     3'-GUCAACGGUGAAGGUGUAUUACACUCA-5'      (SEQ ID NO: 2108)

HIF-1α-557 Target:   5'-CAGTTGCCACTTCCACATAATGTGAGT-3'      (SEQ ID NO: 3156)

5'-GUGAGUUCGCAUCUUGAUAAGGCct-3'        (SEQ ID NO: 2633)
                     3'-UACACUCAAGCGUAGAACUAUUCCGGA-5'      (SEQ ID NO: 2109)

HIF-1α-576 Target:   5'-ATGTGAGTTCGCATCTTGATAAGGCCT-3'      (SEQ ID NO: 3157)

5'-GAGGCUUACCAUCAGCUAUUUGCgt-3'        (SEQ ID NO: 2634)
                     3'-UACUCCGAAUGGUAGUCGAUAAACGCA-5'      (SEQ ID NO: 2110)

HIF-1α-608 Target:   5'-ATGAGGCTTACCATCAGCTATTTGCGT-3'      (SEQ ID NO: 3158)

5'-AGGAAACUUCUGGAUGCUGGUGAtt-3'        (SEQ ID NO: 2635)
                     3'-ACUCCUUUGAAGACCUACGACCACUAA-5'      (SEQ ID NO: 2111)

HIF-1α-636 Target:   5'-TGAGGAAACTTCTGGATGCTGGTGATT-3'      (SEQ ID NO: 3159)

5'-CUGGUGAUUUGGAUAUUGAAGAUga-3'        (SEQ ID NO: 2636)
                     3'-ACGACCACUAAACCUAUAACUUCUACU-5'      (SEQ ID NO: 2112)

HIF-1α-652 Target:   5'-TGCTGGTGATTTGGATATTGAAGATGA-3'      (SEQ ID NO: 3160)

5'-GGUGAUUUGGAUAUUGAAGAUGAca-3'        (SEQ ID NO: 2637)
                     3'-GACCACUAAACCUAUAACUUCUACUGU-5'      (SEQ ID NO: 2113)

HIF-1α-654 Target:   5'-CTGGTGATTTGGATATTGAAGATGACA-3'      (SEQ ID NO: 3161)

5'-UUGGAUAUUGAAGAUGACAUGAAag-3'        (SEQ ID NO: 2638)
                     3'-UAAACCUAUAACUUCUACUGUACUUUC-5'      (SEQ ID NO: 2114)

HIF-1α-660 Target:   5'-ATTTGGATATTGAAGATGACATGAAAG-3'      (SEQ ID NO: 3162)

5'-UGGAUAUUGAAGAUGACAUGAAAgc-3'        (SEQ ID NO: 2639)
                     3'-AAACCUAUAACUUCUACUGUACUUUCG-5'      (SEQ ID NO: 2115)
```

TABLE 2-continued

Selected Anti-HIF-1α DsiRNA Agents (Asymmetrics, HIF-1α)

| | | |
|---|---|---|
| HIF-1α-661 Target: | 5'-TTTGGATATTGAAGATGACATGAAAGC-3' | (SEQ ID NO: 3163) |
| | 5'-GAUAUUGAAGAUGACAUGAAAGCac-3' | (SEQ ID NO: 2640) |
| | 3'-ACCUAUAACUUCUACUGUACUUUCGUG-5' | (SEQ ID NO: 2116) |
| HIF-1α-663 Target: | 5'-TGGATATTGAAGATGACATGAAAGCAC-3' | (SEQ ID NO: 3164) |
| | 5'-AUAUUGAAGAUGACAUGAAAGCAca-3' | (SEQ ID NO: 2641) |
| | 3'-CCUAUAACUUCUACUGUACUUUCGUGU-5' | (SEQ ID NO: 2117) |
| HIF-1α-664 Target: | 5'-GGATATTGAAGATGACATGAAAGCACA-3' | (SEQ ID NO: 3165) |
| | 5'-AGAUGACAUGAAAGCACAGAUGAat-3' | (SEQ ID NO: 2642) |
| | 3'-CUUCUACUGUACUUUCGUGUCUACUUA-5' | (SEQ ID NO: 2118) |
| HIF-1α-671 Target: | 5'-GAAGATGACATGAAAGCACAGATGAAT-3' | (SEQ ID NO: 3166) |
| | 5'-GAUGACAUGAAAGCACAGAUGAAtt-3' | (SEQ ID NO: 2643) |
| | 3'-UUCUACUGUACUUUCGUGUCUACUUAA-5' | (SEQ ID NO: 2119) |
| HIF-1α-672 Target: | 5'-AAGATGACATGAAAGCACAGATGAATT-3' | (SEQ ID NO: 3167) |
| | 5'-AAAGCACAGAUGAAUUGCUUUUAtt-3' | (SEQ ID NO: 2644) |
| | 3'-ACUUUCGUGUCUACUUAACGAAAAUAA-5' | (SEQ ID NO: 2120) |
| HIF-1α-681 Target: | 5'-TGAAAGCACAGATGAATTGCTTTTATT-3' | (SEQ ID NO: 3168) |
| | 5'-CAGAUGAAUUGCUUUUAUUUGAAag-3' | (SEQ ID NO: 2645) |
| | 3'-GUGUCUACUUAACGAAAAUAAACUUUC-5' | (SEQ ID NO: 2121) |
| HIF-1α-687 Target: | 5'-CACAGATGAATTGCTTTTATTTGAAAG-3' | (SEQ ID NO: 3169) |
| | 5'-AGAUGAAUUGCUUUUAUUUGAAAgc-3' | (SEQ ID NO: 2646) |
| | 3'-UGUCUACUUAACGAAAAUAAACUUUCG-5' | (SEQ ID NO: 2122) |
| HIF-1α-688 Target: | 5'-ACAGATGAATTGCTTTTATTTGAAAGC-3' | (SEQ ID NO: 3170) |
| | 5'-UUAUUUGAAAGCCUUGGAUGGUUtt-3' | (SEQ ID NO: 2647) |
| | 3'-AAAAUAAACUUUCGGAACCUACCAAAA-5' | (SEQ ID NO: 2123) |
| HIF-1α-701 Target: | 5'-TTTTATTTGAAAGCCTTGGATGGTTTT-3' | (SEQ ID NO: 3171) |
| | 5'-UAUUUGAAAGCCUUGGAUGGUUUtg-3' | (SEQ ID NO: 2648) |
| | 3'-AAAUAAACUUUCGGAACCUACCAAAAC-5' | (SEQ ID NO: 2124) |
| HIF-1α-702 Target: | 5'-TTTATTTGAAAGCCTTGGATGGTTTTG-3' | (SEQ ID NO: 3172) |
| | 5'-AAAGCCUUGGAUGGUUUUGUUAUgg-3' | (SEQ ID NO: 2649) |
| | 3'-ACUUUCGGAACCUACCAAAACAAUACC-5' | (SEQ ID NO: 2125) |
| HIF-1α-708 Target: | 5'-TGAAAGCCTTGGATGGTTTTGTTATGG-3' | (SEQ ID NO: 3173) |
| | 5'-UUUGUUAUGGUUCUCACAGAUGAtg-3' | (SEQ ID NO: 2650) |
| | 3'-CAAAACAAUACCAAGAGUGUCUACUAC-5' | (SEQ ID NO: 2126) |
| HIF-1α-723 Target: | 5'-GTTTTGTTATGGTTCTCACAGATGATG-3' | (SEQ ID NO: 3174) |
| | 5'-AUGGUUCUCACAGAUGAUGGUGAca-3' | (SEQ ID NO: 2651) |
| | 3'-AAUACCAAGAGUGUCUACUACCACUGU-5' | (SEQ ID NO: 2127) |
| HIF-1α-729 Target: | 5'-TTATGGTTCTCACAGATGATGGTGACA-3' | (SEQ ID NO: 3175) |
| | 5'-UGGUUCUCACAGAUGAUGGUGACat-3' | (SEQ ID NO: 2652) |
| | 3'-AUACCAAGAGUGUCUACUACCACUGUA-5' | (SEQ ID NO: 2128) |
| HIF-1α-730 Target: | 5'-TATGGTTCTCACAGATGATGGTGACAT-3' | (SEQ ID NO: 3176) |
| | 5'-CAGAUGAUGGUGACAUGAUUUACat-3' | (SEQ ID NO: 2653) |
| | 3'-GUGUCUACUACCACUGUACUAAAUGUA-5' | (SEQ ID NO: 2129) |
| HIF-1α-739 Target: | 5'-CACAGATGATGGTGACATGATTTACAT-3' | (SEQ ID NO: 3177) |
| | 5'-GAUGGUGACAUGAUUUACAUUUCtg-3' | (SEQ ID NO: 2654) |
| | 3'-UACUACCACUGUACUAAAUGUAAAGAC-5' | (SEQ ID NO: 2130) |

TABLE 2-continued

Selected Anti-HIF-1α DsiRNA Agents (Asymmetrics, HIF-1α)

```
HIF-1α-744 Target:    5'-ATGATGGTGACATGATTTACATTTCTG-3'   (SEQ ID NO: 3178)

5'-AUGGUGACAUGAUUUACAUUUCUga-3'      (SEQ ID NO: 2655)
                      3'-ACUACCACUGUACUAAAUGUAAAGACU-5'    (SEQ ID NO: 2131)

HIF-1α-745 Target:    5'-TGATGGTGACATGATTTACATTTCTGA-3'   (SEQ ID NO: 3179)

5'-AUGAUUUACAUUUCUGAUAAUGUGa-3'      (SEQ ID NO: 2656)
                      3'-UGUACUAAAUGUAAAGACUAUUACACU-5'    (SEQ ID NO: 2132)

HIF-1α-753 Target:    5'-ACATGATTTACATTTCTGATAATGTGA-3'   (SEQ ID NO: 3180)

5'-GAUUUACAUUUCUGAUAAUGUGAac-3'      (SEQ ID NO: 2657)
                      3'-UACUAAAUGUAAAGACUAUUACACUUG-5'    (SEQ ID NO: 2133)

HIF-1α-755 Target:    5'-ATGATTTACATTTCTGATAATGTGAAC-3'   (SEQ ID NO: 3181)

5'-UUUACAUUUCUGAUAAUGUGAACaa-3'      (SEQ ID NO: 2658)
                      3'-CUAAAUGUAAAGACUAUUACACUUGUU-5'    (SEQ ID NO: 2134)

HIF-1α-757 Target:    5'-GATTTACATTTCTGATAATGTGAACAA-3'   (SEQ ID NO: 3182)

5'-AUUUCUGAUAAUGUGAACAAAUAca-3'      (SEQ ID NO: 2659)
                      3'-UGUAAAGACUAUUACACUUGUUUAUGU-5'    (SEQ ID NO: 2135)

HIF-1α-762 Target:    5'-ACATTTCTGATAATGTGAACAAATACA-3'   (SEQ ID NO: 3183)

5'-UAAUGUGAACAAAUACAUGGGAUta-3'      (SEQ ID NO: 2660)
                      3'-CUAUUACACUUGUUUAUGUACCCUAAU-5'    (SEQ ID NO: 2136)

HIF-1α-770 Target:    5'-GATAATGTGAACAAATACATGGGATTA-3'   (SEQ ID NO: 3184)

5'-AAUGUGAACAAAUACAUGGGAUUaa-3'      (SEQ ID NO: 2661)
                      3'-UAUUACACUUGUUUAUGUACCCUAAUU-5'    (SEQ ID NO: 2137)

HIF-1α-771 Target:    5'-ATAATGTGAACAAATACATGGGATTAA-3'   (SEQ ID NO: 3185)

5'-AUGUGAACAAAUACAUGGGAUUAac-3'      (SEQ ID NO: 2662)
                      3'-AUUACACUUGUUUAUGUACCCUAAUUG-5'    (SEQ ID NO: 2138)

HIF-1α-772 Target:    5'-TAATGTGAACAAATACATGGGATTAAC-3'   (SEQ ID NO: 3186)

5'-UGUGAACAAAUACAUGGGAUUAAct-3'      (SEQ ID NO: 2663)
                      3'-UUACACUUGUUUAUGUACCCUAAUUGA-5'    (SEQ ID NO: 2139)

HIF-1α-773 Target:    5'-AATGTGAACAAATACATGGGATTAACT-3'   (SEQ ID NO: 3187)

5'-GUGAACAAAUACAUGGGAUUAACtc-3'      (SEQ ID NO: 2664)
                      3'-UACACUUGUUUAUGUACCCUAAUUGAG-5'    (SEQ ID NO: 2140)

HIF-1α-774 Target:    5'-ATGTGAACAAATACATGGGATTAACTC-3'   (SEQ ID NO: 3188)

5'-UGAACAAAUACAUGGGAUUAACUca-3'      (SEQ ID NO: 2665)
                      3'-ACACUUGUUUAUGUACCCUAAUUGAGU-5'    (SEQ ID NO: 2141)

HIF-1α-775 Target:    5'-TGTGAACAAATACATGGGATTAACTCA-3'   (SEQ ID NO: 3189)

5'-CAUGGGAUUAACUCAGUUUGAACta-3'      (SEQ ID NO: 2666)
                      3'-AUGUACCCUAAUUGAGUCAAACUUGAU-5'    (SEQ ID NO: 2142)

HIF-1α-785 Target:    5'-TACATGGGATTAACTCAGTTTGAACTA-3'   (SEQ ID NO: 3190)

5'-AUGGGAUUAACUCAGUUUGAACUaa-3'      (SEQ ID NO: 2667)
                      3'-UGUACCCUAAUUGAGUCAAACUUGAUU-5'    (SEQ ID NO: 2143)

HIF-1α-786 Target:    5'-ACATGGGATTAACTCAGTTTGAACTAA-3'   (SEQ ID NO: 3191)

5'-UUUGAACUAACUGGACACAGUGUgt-3'      (SEQ ID NO: 2668)
                      3'-UCAAACUUGAUUGACCUGUGUCACACA-5'    (SEQ ID NO: 2144)

HIF-1α-801 Target:    5'-AGTTTGAACTAACTGGACACAGTGTGT-3'   (SEQ ID NO: 3192)

5'-CUGGACACAGUGUGUUUGAUUUUac-3'      (SEQ ID NO: 2669)
                      3'-UUGACCUGUGUCACACAAACUAAAAUG-5'    (SEQ ID NO: 2145)
```

TABLE 2-continued

Selected Anti-HIF-1α DsiRNA Agents (Asymmetrics, HIF-1α)

```
HIF-1α-811 Target:  5'-AACTGGACACAGTGTGTTTGATTTTAC-3'      (SEQ ID NO: 3193)

5'-UGGACACAGUGUGUUUGAUUUUAct-3'         (SEQ ID NO: 2670)
                    3'-UGACCUGUGUCACACAAACUAAAAUGA-5'       (SEQ ID NO: 2146)

HIF-1α-812 Target:  5'-ACTGGACACAGTGTGTTTGATTTTACT-3'      (SEQ ID NO: 3194)

5'-UUUGAUUUUACUCAUCCAUGUGAcc-3'         (SEQ ID NO: 2671)
                    3'-ACAAACUAAAAUGAGUAGGUACACUGG-5'       (SEQ ID NO: 2147)

HIF-1α-825 Target:  5'-TGTTTGATTTTACTCATCCATGTGACC-3'      (SEQ ID NO: 3195)

5'-UGAUUUUACUCAUCCAUGUGACCat-3'         (SEQ ID NO: 2672)
                    3'-AAACUAAAAUGAGUAGGUACACUGGUA-5'       (SEQ ID NO: 2148)

HIF-1α-827 Target:  5'-TTTGATTTTACTCATCCATGTGACCAT-3'      (SEQ ID NO: 3196)

5'-CAUGUGACCAUGAGGAAAUGAGAGAga-3'       (SEQ ID NO: 2673)
                    3'-AGGUACACUGGUACUCCUUUACUCUCU-5'       (SEQ ID NO: 2149)

HIF-1α-841 Target:  5'-TCCATGTGACCATGAGGAAATGAGAGA-3'      (SEQ ID NO: 3197)

5'-UGUGACCAUGAGGAAAUGAGAGAaa-3'         (SEQ ID NO: 2674)
                    3'-GUACACUGGUACUCCUUUACUCUCUUU-5'       (SEQ ID NO: 2150)

HIF-1α-843 Target:  5'-CATGTGACCATGAGGAAATGAGAGAAA-3'      (SEQ ID NO: 3198)

5'-CAUGAGGAAAUGAGAGAAAUGCUta-3'         (SEQ ID NO: 2675)
                    3'-UGGUACUCCUUUACUCUCUUUACGAAU-5'       (SEQ ID NO: 2151)

HIF-1α-849 Target:  5'-ACCATGAGGAAATGAGAGAAATGCTTA-3'      (SEQ ID NO: 3199)

5'-AGAGAAAUGCUUACACACAGAAAtg-3'         (SEQ ID NO: 2676)
                    3'-ACUCUCUUUACGAAUGUGUGUCUUUAC-5'       (SEQ ID NO: 2152)

HIF-1α-861 Target:  5'-TGAGAGAAATGCTTACACACAGAAATG-3'      (SEQ ID NO: 3200)

5'-AAAUGCUUACACACAGAAAUGGCct-3'         (SEQ ID NO: 2677)
                    3'-UCUUUACGAAUGUGUGUCUUUACCGGA-5'       (SEQ ID NO: 2153)

HIF-1α-865 Target:  5'-AGAAATGCTTACACACAGAAATGGCCT-3'      (SEQ ID NO: 3201)

5'-AAUGCUUACACACAGAAAUGGCCtt-3'         (SEQ ID NO: 2678)
                    3'-CUUUACGAAUGUGUGUCUUUACCGGAA-5'       (SEQ ID NO: 2154)

HIF-1α-866 Target:  5'-GAAATGCTTACACACAGAAATGGCCTT-3'      (SEQ ID NO: 3202)

5'-GAAAUGGCCUUGUGAAAAGGGUaa-3'          (SEQ ID NO: 2679)
                    3'-GUCUUUACCGGAACACUUUUUCCCAUU-5'       (SEQ ID NO: 2155)

HIF-1α-880 Target:  5'-CAGAAATGGCCTTGTGAAAAGGGTAA-3'       (SEQ ID NO: 3203)

5'-AAAUGGCCUUGUGAAAAGGGUAaa-3'          (SEQ ID NO: 2680)
                    3'-UCUUUACCGGAACACUUUUUCCCAUUU-5'       (SEQ ID NO: 2156)

HIF-1α-881 Target:  5'-AGAAATGGCCTTGTGAAAAGGGTAAA-3'       (SEQ ID NO: 3204)

5'-AAUGGCCUUGUGAAAAGGGUAAag-3'          (SEQ ID NO: 2681)
                    3'-CUUUACCGGAACACUUUUUCCCAUUUC-5'       (SEQ ID NO: 2157)

HIF-1α-882 Target:  5'-GAAATGGCCTTGTGAAAAGGGTAAAG-3'       (SEQ ID NO: 3205)

5'-AUGGCCUUGUGAAAAGGGUAAAga-3'          (SEQ ID NO: 2682)
                    3'-UUUACCGGAACACUUUUUCCCAUUUCU-5'       (SEQ ID NO: 2158)

HIF-1α-883 Target:  5'-AAATGGCCTTGTGAAAAGGGTAAAGA-3'       (SEQ ID NO: 3206)

5'-CUUGUGAAAAGGGUAAAGAACAaa-3'          (SEQ ID NO: 2683)
                    3'-CGGAACACUUUUUCCCAUUUCUUGUUU-5'       (SEQ ID NO: 2159)

HIF-1α-888 Target:  5'-GCCTTGTGAAAAGGGTAAAGAACAAA-3'       (SEQ ID NO: 3207)

5'-AAGAACAAAACACACAGCGAAGCtt-3'         (SEQ ID NO: 2684)
                    3'-AUUCUUGUUUUGUGUGUCGCUUCGAA-5'        (SEQ ID NO: 2160)
```

TABLE 2-continued

Selected Anti-HIF-1α DsiRNA Agents (Asymmetrics, HIF-1α)

```
HIF-1α-904  Target:  5'-TAAAGAACAAAACACACAGCGAAGCTT-3'      (SEQ ID NO: 3208)

5'-CUUUUUUCUCAGAAUGAAGUGUAcc-3'        (SEQ ID NO: 2685)
                     3'-UCGAAAAAAGAGUCUUACUUCACAUGG-5'      (SEQ ID NO: 2161)

HIF-1α-926  Target:  5'-AGCTTTTTTCTCAGAATGAAGTGTACC-3'      (SEQ ID NO: 3209)

5'-UUUUUCUCAGAAUGAAGUGUACCct-3'        (SEQ ID NO: 2686)
                     3'-GAAAAAAGAGUCUUACUUCACAUGGGA-5'      (SEQ ID NO: 2162)

HIF-1α-928  Target:  5'-CTTTTTTCTCAGAATGAAGTGTACCCT-3'      (SEQ ID NO: 3210)

5'-AAUGAAGUGUACCCUAACUAGCCga-3'        (SEQ ID NO: 2687)
                     3'-UCUUACUUCACAUGGGAUUGAUCGGCU-5'      (SEQ ID NO: 2163)

HIF-1α-938  Target:  5'-AGAATGAAGTGTACCCTAACTAGCCGA-3'      (SEQ ID NO: 3211)

5'-AGGAAGAACUAUGAACAUAAAGUct-3'        (SEQ ID NO: 2688)
                     3'-GCUCCUUCUUGAUACUUGUAUUUCAGA-5'      (SEQ ID NO: 2164)

HIF-1α-962  Target:  5'-CGAGGAAGAACTATGAACATAAAGTCT-3'      (SEQ ID NO: 3212)

5'-GGAAGAACUAUGAACAUAAAGUCtg-3'        (SEQ ID NO: 2689)
                     3'-CUCCUUCUUGAUACUUGUAUUUCAGAC-5'      (SEQ ID NO: 2165)

HIF-1α-963  Target:  5'-GAGGAAGAACTATGAACATAAAGTCTG-3'      (SEQ ID NO: 3213)

5'-GAAGAACUAUGAACAUAAAGUCUgc-3'        (SEQ ID NO: 2690)
                     3'-UCCUUCUUGAUACUUGUAUUUCAGACG-5'      (SEQ ID NO: 2166)

HIF-1α-964  Target:  5'-AGGAAGAACTATGAACATAAAGTCTGC-3'      (SEQ ID NO: 3214)

5'-CAGGCCACAUUCACGUAUAUGAUac-3'        (SEQ ID NO: 2691)
                     3'-GUGUCCGGUGUAAGUGCAUAUACUAUG-5'      (SEQ ID NO: 2167)

HIF-1α-1012 Target:  5'-CACAGGCCACATTCACGTATATGATAC-3'      (SEQ ID NO: 3215)

5'-UGGGUAUAAGAAACCACCUAUGAcc-3'        (SEQ ID NO: 2692)
                     3'-ACACCCAUAUUCUUUGGUGGAUACUGG-5'      (SEQ ID NO: 2168)

HIF-1α-1058 Target:  5'-TGTGGGTATAAGAAACCACCTATGACC-3'      (SEQ ID NO: 3216)

5'-GGGUAUAAGAAACCACCUAUGACct-3'        (SEQ ID NO: 2693)
                     3'-CACCCAUAUUCUUUGGUGGAUACUGGA-5'      (SEQ ID NO: 2169)

HIF-1α-1059 Target:  5'-GTGGGTATAAGAAACCACCTATGACCT-3'      (SEQ ID NO: 3217)

5'-AUAUUGAAAUUCCUUUAGAUAGCaa-3'        (SEQ ID NO: 2694)
                     3'-UUUAUAACUUUAAGGAAAUCUAUCGUU-5'      (SEQ ID NO: 2170)

HIF-1α-1123 Target:  5'-AAATATTGAAATTCCTTTAGATAGCAA-3'      (SEQ ID NO: 3218)

5'-AAAUUCCUUUAGAUAGCAAGACUtt-3'        (SEQ ID NO: 2695)
                     3'-ACUUUAAGGAAAUCUAUCGUUCUGAAA-5'      (SEQ ID NO: 2171)

HIF-1α-1129 Target:  5'-TGAAATTCCTTTAGATAGCAAGACTTT-3'      (SEQ ID NO: 3219)

5'-GAUAUGAAAUUUUCUUAUUGUGAtg-3'        (SEQ ID NO: 2696)
                     3'-ACCUAUACUUUAAAAGAAUAACACUAC-5'      (SEQ ID NO: 2172)

HIF-1α-1173 Target:  5'-TGGATATGAAATTTTCTTATTGTGATG-3'      (SEQ ID NO: 3220)

5'-AUGAAAUUUUCUUAUUGUGAUGAaa-3'        (SEQ ID NO: 2697)
                     3'-UAUACUUUAAAAGAAUAACACUACUUU-5'      (SEQ ID NO: 2173)

HIF-1α-1176 Target:  5'-ATATGAAATTTTCTTATTGTGATGAAA-3'      (SEQ ID NO: 3221)

5'-UGAAAUUUUCUUAUUGUGAUGAAag-3'        (SEQ ID NO: 2698)
                     3'-AUACUUUAAAAGAAUAACACUACUUUC-5'      (SEQ ID NO: 2174)

HIF-1α-1177 Target:  5'-TATGAAATTTTCTTATTGTGATGAAAG-3'      (SEQ ID NO: 3222)

5'-GAAAUUUUCUUAUUGUGAUGAAAga-3'        (SEQ ID NO: 2699)
                     3'-UACUUUAAAAGAAUAACACUACUUUCU-5'      (SEQ ID NO: 2175)
```

TABLE 2-continued

Selected Anti-HIF-1α DsiRNA Agents (Asymmetrics, HIF-1α)

| | | |
|---|---|---|
| HIF-1α-1178 Target: | 5'-ATGAAATTTTCTTATTGTGATGAAAGA-3' | (SEQ ID NO: 3223) |
| | 5'-AAUUUCUUAUUGUGAUGAAAGAat-3' | (SEQ ID NO: 2700) |
| | 3'-CUUUAAAAGAAUAACACUACUUUCUUA-5' | (SEQ ID NO: 2176) |
| HIF-1α-1180 Target: | 5'-GAAATTTTCTTATTGTGATGAAAGAAT-3' | (SEQ ID NO: 3224) |
| | 5'-AUUUUCUUAUUGUGAUGAAAGAAtt-3' | (SEQ ID NO: 2701) |
| | 3'-UUUAAAAGAAUAACACUACUUUCUUAA-5' | (SEQ ID NO: 2177) |
| HIF-1α-1181 Target: | 5'-AAATTTTCTTATTGTGATGAAAGAATT-3' | (SEQ ID NO: 3225) |
| | 5'-UUUUCUUAUUGUGAUGAAAGAAUta-3' | (SEQ ID NO: 2702) |
| | 3'-UUAAAAGAAUAACACUACUUUCUUAAU-5' | (SEQ ID NO: 2178) |
| HIF-1α-1182 Target: | 5'-AATTTTCTTATTGTGATGAAAGAATTA-3' | (SEQ ID NO: 3226) |
| | 5'-CUUAUUGUGAUGAAAGAAUUACCga-3' | (SEQ ID NO: 2703) |
| | 3'-AAGAAUAACACUACUUUCUUAAUGGCU-5' | (SEQ ID NO: 2179) |
| HIF-1α-1186 Target: | 5'-TTCTTATTGTGATGAAAGAATTACCGA-3' | (SEQ ID NO: 3227) |
| | 5'-UGUGAUGAAAGAAUUACCGAAUUga-3' | (SEQ ID NO: 2704) |
| | 3'-UAACACUACUUUCUUAAUGGCUUAACU-5' | (SEQ ID NO: 2180) |
| HIF-1α-1191 Target: | 5'-ATTGTGATGAAAGAATTACCGAATTGA-3' | (SEQ ID NO: 3228) |
| | 5'-UGAUGAAAGAAUUACCGAAUUGAtg-3' | (SEQ ID NO: 2705) |
| | 3'-ACACUACUUUCUUAAUGGCUUAACUAC-5' | (SEQ ID NO: 2181) |
| HIF-1α-1193 Target: | 5'-TGTGATGAAAGAATTACCGAATTGATG-3' | (SEQ ID NO: 3229) |
| | 5'-AAAGAAUUACCGAAUUGAUGGGAta-3' | (SEQ ID NO: 2706) |
| | 3'-ACUUUCUUAAUGGCUUAACUACCCUAU-5' | (SEQ ID NO: 2182) |
| HIF-1α-1198 Target: | 5'-TGAAAGAATTACCGAATTGATGGGATA-3' | (SEQ ID NO: 3230) |
| | 5'-AAGAAUUACCGAAUUGAUGGGAUat-3' | (SEQ ID NO: 2707) |
| | 3'-CUUUCUUAAUGGCUUAACUACCCUAUA-5' | (SEQ ID NO: 2183) |
| HIF-1α-1199 Target: | 5'-GAAAGAATTACCGAATTGATGGGATAT-3' | (SEQ ID NO: 3231) |
| | 5'-AGAAUUACCGAAUUGAUGGGAUAtg-3' | (SEQ ID NO: 2708) |
| | 3'-UUUCUUAAUGGCUUAACUACCCUAUAC-5' | (SEQ ID NO: 2184) |
| HIF-1α-1200 Target: | 5'-AAAGAATTACCGAATTGATGGGATATG-3' | (SEQ ID NO: 3232) |
| | 5'-GAAUUACCGAAUUGAUGGGAUAUga-3' | (SEQ ID NO: 2709) |
| | 3'-UUCUUAAUGGCUUAACUACCCUAUACU-5' | (SEQ ID NO: 2185) |
| HIF-1α-1201 Target: | 5'-AAGAATTACCGAATTGATGGGATATGA-3' | (SEQ ID NO: 3233) |
| | 5'-AUGGGAUAUGAGCCAGAAGAACUtt-3' | (SEQ ID NO: 2710) |
| | 3'-ACUACCCUAUACUCGGUCUUCUUGAAA-5' | (SEQ ID NO: 2186) |
| HIF-1α-1215 Target: | 5'-TGATGGGATATGAGCCAGAAGAACTTT-3' | (SEQ ID NO: 3234) |
| | 5'-AUGAGCCAGAAGAACUUUUAGGCcg-3' | (SEQ ID NO: 2711) |
| | 3'-UAUACUCGGUCUUCUUGAAAAUCCGGC-5' | (SEQ ID NO: 2187) |
| HIF-1α-1222 Target: | 5'-ATATGAGCCAGAAGAACTTTTAGGCCG-3' | (SEQ ID NO: 3235) |
| | 5'-UAGGCCGCUCAAUUUAUGAAUAUta-3' | (SEQ ID NO: 2712) |
| | 3'-AAAUCCGGCGAGUUAAAUACUUAUAAU-5' | (SEQ ID NO: 2188) |
| HIF-1α-1240 Target: | 5'-TTTAGGCCGCTCAATTTATGAATATTA-3' | (SEQ ID NO: 3236) |
| | 5'-UAUGAAUAUUAUCAUGCUUUGGAct-3' | (SEQ ID NO: 2713) |
| | 3'-AAAUACUUAUAAUAGUACGAAACCUGA-5' | (SEQ ID NO: 2189) |
| HIF-1α-1254 Target: | 5'-TTTATGAATATTATCATGCTTTGGACT-3' | (SEQ ID NO: 3237) |
| | 5'-UGAAUAUUAUCAUGCUUUGGACUct-3' | (SEQ ID NO: 2714) |
| | 3'-AUACUUAUAAUAGUACGAAACCUGAGA-5' | (SEQ ID NO: 2190) |

TABLE 2-continued

Selected Anti-HIF-1α DsiRNA Agents (Asymmetrics, HIF-1α)

```
HIF-1α-1256  Target: 5'-TATGAATATTATCATGCTTTGGACTCT-3'      (SEQ ID NO: 3238)

5'-CUGACCAAAACUCAUCAUGAUAUGt-3'         (SEQ ID NO: 2715)
                     3'-UAGACUGGUUUUGAGUAGUACUAUACA-5'       (SEQ ID NO: 2191)

HIF-1α-1287  Target: 5'-ATCTGACCAAAACTCATCATGATATGT-3'      (SEQ ID NO: 3239)

5'-CAAAACUCAUCAUGAUAUGUUUAct-3'         (SEQ ID NO: 2716)
                     3'-UGGUUUUGAGUAGUACUAUACAAAUGA-5'       (SEQ ID NO: 2192)

HIF-1α-1292  Target: 5'-ACCAAAACTCATCATGATATGTTTACT-3'      (SEQ ID NO: 3240)

5'-AAAACUCAUCAUGAUAUGUUUACta-3'         (SEQ ID NO: 2717)
                     3'-GGUUUUGAGUAGUACUAUACAAAUGAU-5'       (SEQ ID NO: 2193)

HIF-1α-1293  Target: 5'-CCAAAACTCATCATGATATGTTTACTA-3'      (SEQ ID NO: 3241)

5'-CAUGAUAUGUUUACUAAAGGACAag-3'         (SEQ ID NO: 2718)
                     3'-UAGUACUAUACAAAUGAUUUCCUGUUC-5'       (SEQ ID NO: 2194)

HIF-1α-1302  Target: 5'-ATCATGATATGTTTACTAAAGGACAAG-3'      (SEQ ID NO: 3242)

5'-AUAUGUUUACUAAAGGACAAGUCac-3'         (SEQ ID NO: 2719)
                     3'-ACUAUACAAAUGAUUUCCUGUUCAGUG-5'       (SEQ ID NO: 2195)

HIF-1α-1306  Target: 5'-TGATATGTTTACTAAAGGACAAGTCAC-3'      (SEQ ID NO: 3243)

5'-GGUGGAUAUGUCUGGGUUGAAACtc-3'         (SEQ ID NO: 2720)
                     3'-CUCCACCUAUACAGACCCAACUUUGAG-5'       (SEQ ID NO: 2196)

HIF-1α-1362  Target: 5'-GAGGTGGATATGTCTGGGTTGAAACTC-3'      (SEQ ID NO: 3244)

5'-GGUUGAAACUCAAGCAACUGUCAta-3'         (SEQ ID NO: 2721)
                     3'-ACCCAACUUUGAGUUCGUUGACAGUAU-5'       (SEQ ID NO: 2197)

HIF-1α-1376  Target: 5'-TGGGTTGAAACTCAAGCAACTGTCATA-3'      (SEQ ID NO: 3245)

5'-CUGUCAUAUAUAACACCAAGAAUtc-3'         (SEQ ID NO: 2722)
                     3'-UUGACAGUAUAUAUUGUGGUUCUUAAG-5'       (SEQ ID NO: 2198)

HIF-1α-1393  Target: 5'-AACTGTCATATATAACACCAAGAATTC-3'      (SEQ ID NO: 3246)

5'-CAAGAAUUCUCAACCACAGUGCAtt-3'         (SEQ ID NO: 2723)
                     3'-UGGUUCUUAAGAGUUGGUGUCACGUAA-5'       (SEQ ID NO: 2199)

HIF-1α-1409  Target: 5'-ACCAAGAATTCTCAACCACAGTGCATT-3'      (SEQ ID NO: 3247)

5'-CAGUGCAUUGUAUGUGUGAAUUAcg-3'         (SEQ ID NO: 2724)
                     3'-GUGUCACGUAACAUACACACUUAAUGC-5'       (SEQ ID NO: 2200)

HIF-1α-1425  Target: 5'-CACAGTGCATTGTATGTGTGAATTACG-3'      (SEQ ID NO: 3248)

5'-AGUGCAUUGUAUGUGUGAAUUACgt-3'         (SEQ ID NO: 2725)
                     3'-UGUCACGUAACAUACACACUUAAUGCA-5'       (SEQ ID NO: 2201)

HIF-1α-1426  Target: 5'-ACAGTGCATTGTATGTGTGAATTACGT-3'      (SEQ ID NO: 3249)

5'-GUGUGAAUUACGUUGUGAGUGGUat-3'         (SEQ ID NO: 2726)
                     3'-UACACACUUAAUGCAACACUCACCAUA-5'       (SEQ ID NO: 2202)

HIF-1α-1438  Target: 5'-ATGTGTGAATTACGTTGTGAGTGGTAT-3'      (SEQ ID NO: 3250)

5'-UGUGAAUUACGUUGUGAGUGGUAtt-3'         (SEQ ID NO: 2727)
                     3'-ACACACUUAAUGCAACACUCACCAUAA-5'       (SEQ ID NO: 2203)

HIF-1α-1439  Target: 5'-TGTGTGAATTACGTTGTGAGTGGTATT-3'      (SEQ ID NO: 3251)

5'-GUGAAUUACGUUGUGAGUGGUAUta-3'         (SEQ ID NO: 2728)
                     3'-CACACUUAAUGCAACACUCACCAUAAU-5'       (SEQ ID NO: 2204)

HIF-1α-1440  Target: 5'-GTGTGAATTACGTTGTGAGTGGTATTA-3'      (SEQ ID NO: 3252)

5'-UGAAUUACGUUGUGAGUGGUAUUat-3'         (SEQ ID NO: 2729)
                     3'-ACACUUAAUGCAACACUCACCAUAAUA-5'       (SEQ ID NO: 2205)
```

TABLE 2-continued

Selected Anti-HIF-1α DsiRNA Agents (Asymmetrics, HIF-1α)

```
HIF-1α-1441  Target: 5'-TGTGAATTACGTTGTGAGTGGTATTAT-3'     (SEQ ID NO: 3253)

5'-GUAUUAUUCAGCACGACUUGAUUtt-3'       (SEQ ID NO: 2730)
                     3'-ACCAUAAUAAGUCGUGCUGAACUAAAA-5'     (SEQ ID NO: 2206)

HIF-1α-1459  Target: 5'-TGGTATTATTCAGCACGACTTGATTTT-3'     (SEQ ID NO: 3254)

5'-UGAUUUUCUCCCUUCAACAAACAga-3'       (SEQ ID NO: 2731)
                     3'-GAACUAAAAGAGGGAAGUUGUUUGUCU-5'     (SEQ ID NO: 2207)

HIF-1α-1477  Target: 5'-CTTGATTTTCTCCCTTCAACAAACAGA-3'     (SEQ ID NO: 3255)

5'-CAAACAGAAUGUGUCCUUAAACCgg-3'       (SEQ ID NO: 2732)
                     3'-UUGUUUGUCUUACACAGGAAUUUGGCC-5'     (SEQ ID NO: 2208)

HIF-1α-1494  Target: 5'-AACAAACAGAATGTGTCCTTAAACCGG-3'     (SEQ ID NO: 3256)

5'-UGUGUCCUUAAACCGGUUGAAUCtt-3'       (SEQ ID NO: 2733)
                     3'-UUACACAGGAAUUUGGCCAACUUAGAA-5'     (SEQ ID NO: 2209)

HIF-1α-1503  Target: 5'-AATGTGTCCTTAAACCGGTTGAATCTT-3'     (SEQ ID NO: 3257)

5'-CGGUUGAAUCUUCAGAUAUGAAAat-3'       (SEQ ID NO: 2734)
                     3'-UGGCCAACUUAGAAGUCUAUACUUUUA-5'     (SEQ ID NO: 2210)

HIF-1α-1516  Target: 5'-ACCGGTTGAATCTTCAGATATGAAAAT-3'     (SEQ ID NO: 3258)

5'-GGUUGAAUCUUCAGAUAUGAAAAtg-3'       (SEQ ID NO: 2735)
                     3'-GGCCAACUUAGAAGUCUAUACUUUUAC-5'     (SEQ ID NO: 2211)

HIF-1α-1517  Target: 5'-CCGGTTGAATCTTCAGATATGAAAATG-3'     (SEQ ID NO: 3259)

5'-GUUGAAUCUUCAGAUAUGAAAAUga-3'       (SEQ ID NO: 2736)
                     3'-GCCAACUUAGAAGUCUAUACUUUUACU-5'     (SEQ ID NO: 2212)

HIF-1α-1518  Target: 5'-CGGTTGAATCTTCAGATATGAAAATGA-3'     (SEQ ID NO: 3260)

5'-UGAAUCUUCAGAUAUGAAAAUGAct-3'       (SEQ ID NO: 2737)
                     3'-CAACUUAGAAGUCUAUACUUUUACUGA-5'     (SEQ ID NO: 2213)

HIF-1α-1520  Target: 5'-GTTGAATCTTCAGATATGAAAATGACT-3'     (SEQ ID NO: 3261)

5'-GAAUCUUCAGAUAUGAAAAUGACtc-3'       (SEQ ID NO: 2738)
                     3'-AACUUAGAAGUCUAUACUUUUACUGAG-5'     (SEQ ID NO: 2214)

HIF-1α-1521  Target: 5'-TTGAATCTTCAGATATGAAAATGACTC-3'     (SEQ ID NO: 3262)

5'-AUAUGAAAAUGACUCAGCUAUUCac-3'       (SEQ ID NO: 2739)
                     3'-UCUAUACUUUUACUGAGUCGAUAAGUG-5'     (SEQ ID NO: 2215)

HIF-1α-1531  Target: 5'-AGATATGAAAATGACTCAGCTATTCAC-3'     (SEQ ID NO: 3263)

5'-UAUGAAAAUGACUCAGCUAUUCAcc-3'       (SEQ ID NO: 2740)
                     3'-CUAUACUUUUACUGAGUCGAUAAGUGG-5'     (SEQ ID NO: 2216)

HIF-1α-1532  Target: 5'-GATATGAAAATGACTCAGCTATTCACC-3'     (SEQ ID NO: 3264)

5'-AGUUGAAUCAGAAGAUACAAGUAgc-3'       (SEQ ID NO: 2741)
                     3'-UUUCAACUUAGUCUUCUAUGUUCAUCG-5'     (SEQ ID NO: 2217)

HIF-1α-1559  Target: 5'-AAAGTTGAATCAGAAGATACAAGTAGC-3'     (SEQ ID NO: 3265)

5'-UUGAAUCAGAAGAUACAAGUAGCct-3'       (SEQ ID NO: 2742)
                     3'-UCAACUUAGUCUUCUAUGUUCAUCGGA-5'     (SEQ ID NO: 2218)

HIF-1α-1561  Target: 5'-AGTTGAATCAGAAGATACAAGTAGCCT-3'     (SEQ ID NO: 3266)

5'-GAAGAUACAAGUAGCCUCUUUGAca-3'       (SEQ ID NO: 2743)
                     3'-GUCUUCUAUGUUCAUCGGAGAAACUGU-5'     (SEQ ID NO: 2219)

HIF-1α-1569  Target: 5'-CAGAAGATACAAGTAGCCTCTTTGACA-3'     (SEQ ID NO: 3267)

5'-AAGAUACAAGUAGCCUCUUUGACaa-3'       (SEQ ID NO: 2744)
                     3'-UCUUCUAUGUUCAUCGGAGAAACUGUU-5'     (SEQ ID NO: 2220)
```

TABLE 2-continued

Selected Anti-HIF-1α DsiRNA Agents (Asymmetrics, HIF-1α)

```
HIF-1α-1570   Target:  5'-AGAAGATACAAGTAGCCTCTTTGACAA-3'       (SEQ ID NO: 3268)

5'-AGAUACAAGUAGCCUCUUUGACAaa-3'         (SEQ ID NO: 2745)
                       3'-CUUCUAUGUUCAUCGGAGAAACUGUUU-5'       (SEQ ID NO: 2221)

HIF-1α-1571   Target:  5'-GAAGATACAAGTAGCCTCTTTGACAAA-3'       (SEQ ID NO: 3269)

5'-CUUUGACAAACUUAAGAAGGAACct-3'         (SEQ ID NO: 2746)
                       3'-GAGAAACUGUUUGAAUUCUUCCUUGGA-5'       (SEQ ID NO: 2222)

HIF-1α-1586   Target:  5'-CTCTTTGACAAACTTAAGAAGGAACCT-3'       (SEQ ID NO: 3270)

5'-UUUGACAAACUUAAGAAGGAACCtg-3'         (SEQ ID NO: 2747)
                       3'-AGAAACUGUUUGAAUUCUUCCUUGGAC-5'       (SEQ ID NO: 2223)

HIF-1α-1587   Target:  5'-TCTTTGACAAACTTAAGAAGGAACCTG-3'       (SEQ ID NO: 3271)

5'-CUGAUGCUUUAACUUUGCUGGCCcc-3'         (SEQ ID NO: 2748)
                       3'-UGGACUACGAAAUUGAAACGACCGGGG-5'       (SEQ ID NO: 2224)

HIF-1α-1609   Target:  5'-ACCTGATGCTTTAACTTTGCTGGCCCC-3'       (SEQ ID NO: 3272)

5'-GGAGACACAAUCAUAUCUUUAGAtt-3'         (SEQ ID NO: 2749)
                       3'-GACCUCUGUGUUAGUAUAGAAAUCUAA-5'       (SEQ ID NO: 2225)

HIF-1α-1641   Target:  5'-CTGGAGACACAATCATATCTTTAGATT-3'       (SEQ ID NO: 3273)

5'-GAGACACAAUCAUAUCUUUAGAUtt-3'         (SEQ ID NO: 2750)
                       3'-ACCUCUGUGUUAGUAUAGAAAUCUAAA-5'       (SEQ ID NO: 2226)

HIF-1α-1642   Target:  5'-TGGAGACACAATCATATCTTTAGATTT-3'       (SEQ ID NO: 3274)

5'-CUUGAGGAAGUACCAUUAUAUAAtg-3'         (SEQ ID NO: 2751)
                       3'-UUGAACUCCUUCAUGGUAAUAUAUUAC-5'       (SEQ ID NO: 2227)

HIF-1α-1701   Target:  5'-AACTTGAGGAAGTACCATTATATAATG-3'       (SEQ ID NO: 3275)

5'-UUGAGGAAGUACCAUUAUAUAAUga-3'         (SEQ ID NO: 2752)
                       3'-UGAACUCCUUCAUGGUAAUAUAUUACU-5'       (SEQ ID NO: 2228)

HIF-1α-1702   Target:  5'-ACTTGAGGAAGTACCATTATATAATGA-3'       (SEQ ID NO: 3276)

5'-GAGGAAGUACCAUUAUAUAAUGAtg-3'         (SEQ ID NO: 2753)
                       3'-AACUCCUUCAUGGUAAUAUAUUACUAC-5'       (SEQ ID NO: 2229)

HIF-1α-1704   Target:  5'-TTGAGGAAGTACCATTATATAATGATG-3'       (SEQ ID NO: 3277)

5'-AGGAAGUACCAUUAUAUAAUGAUgt-3'         (SEQ ID NO: 2754)
                       3'-ACUCCUUCAUGGUAAUAUAUUACUACA-5'       (SEQ ID NO: 2230)

HIF-1α-1705   Target:  5'-TGAGGAAGTACCATTATATAATGATGT-3'       (SEQ ID NO: 3278)

5'-GAAGUACCAUUAUAUAAUGAUGUaa-3'         (SEQ ID NO: 2755)
                       3'-UCCUUCAUGGUAAUAUAUUACUACAUU-5'       (SEQ ID NO: 2231)

HIF-1α-1707   Target:  5'-AGGAAGTACCATTATATAATGATGTAA-3'       (SEQ ID NO: 3279)

5'-AAGUACCAUUAUAUAAUGAUGUAat-3'         (SEQ ID NO: 2756)
                       3'-CCUUCAUGGUAAUAUAUUACUACAUUA-5'       (SEQ ID NO: 2232)

HIF-1α-1708   Target:  5'-GGAAGTACCATTATATAATGATGTAAT-3'       (SEQ ID NO: 3280)

5'-CGAAAAAUUACAGAAUAUAAAUUtg-3'         (SEQ ID NO: 2757)
                       3'-UUGCUUUUUAAUGUCUUAUAUUUAAAC-5'       (SEQ ID NO: 2233)

HIF-1α-1748   Target:  5'-AACGAAAAATTACAGAATATAAATTTG-3'       (SEQ ID NO: 3281)

5'-GAAAAAUUACAGAAUAUAAAUUUgg-3'         (SEQ ID NO: 2758)
                       3'-UGCUUUUUAAUGUCUUAUAUUUAAACC-5'       (SEQ ID NO: 2234)

HIF-1α-1749   Target:  5'-ACGAAAAATTACAGAATATAAATTTGG-3'       (SEQ ID NO: 3282)

5'-AAAUUACAGAAUAUAAAUUUGGCaa-3'         (SEQ ID NO: 2759)
                       3'-UUUUUAAUGUCUUAUAUUUAAACCGUU-5'       (SEQ ID NO: 2235)
```

TABLE 2-continued

Selected Anti-HIF-1α DsiRNA Agents (Asymmetrics, HIF-1α)

```
HIF-1α-1752  Target: 5'-AAAAATTACAGAATATAAATTTGGCAA-3'    (SEQ ID NO: 3283)

5'-CAGAAUAUAAAUUUGGCAAUGUCtc-3'      (SEQ ID NO: 2760)
                     3'-AUGUCUUAUAUUUAAACCGUUACAGAG-5'    (SEQ ID NO: 2236)

HIF-1α-1758  Target: 5'-TACAGAATATAAATTTGGCAATGTCTC-3'    (SEQ ID NO: 3284)

5'-AGAAUAUAAAUUUGGCAAUGUCUcc-3'      (SEQ ID NO: 2761)
                     3'-UGUCUUAUAUUUAAACCGUUACAGAGG-5'    (SEQ ID NO: 2237)

HIF-1α-1759  Target: 5'-ACAGAATATAAATTTGGCAATGTCTCC-3'    (SEQ ID NO: 3285)

5'-CAAGAAGUUGCAUUAAAAUUAGAac-3'      (SEQ ID NO: 2762)
                     3'-UAGUUCUUCAACGUAAUUUUAAUCUUG-5'    (SEQ ID NO: 2238)

HIF-1α-1842  Target: 5'-ATCAAGAAGTTGCATTAAAATTAGAAC-3'    (SEQ ID NO: 3286)

5'-AAGAAGUUGCAUUAAAAUUAGAAcc-3'      (SEQ ID NO: 2763)
                     3'-AGUUCUUCAACGUAAUUUUAAUCUUGG-5'    (SEQ ID NO: 2239)

HIF-1α-1843  Target: 5'-TCAAGAAGTTGCATTAAAATTAGAACC-3'    (SEQ ID NO: 3287)

5'-AAAUUAGAACCAAAUCCAGAGUCac-3'      (SEQ ID NO: 2764)
                     3'-AUUUUAAUCUUGGUUUAGGUCUCAGUG-5'    (SEQ ID NO: 2240)

HIF-1α-1857  Target: 5'-TAAAATTAGAACCAAATCCAGAGTCAC-3'    (SEQ ID NO: 3288)

5'-AAUUAGAACCAAAUCCAGAGUCAct-3'      (SEQ ID NO: 2765)
                     3'-UUUUAAUCUUGGUUUAGGUCUCAGUGA-5'    (SEQ ID NO: 2241)

HIF-1α-1858  Target: 5'-AAAATTAGAACCAAATCCAGAGTCACT-3'    (SEQ ID NO: 3289)

5'-AGAGUCACUGGAACUUUCUUUUAcc-3'      (SEQ ID NO: 2766)
                     3'-GGUCUCAGUGACCUUGAAAGAAAAUGG-5'    (SEQ ID NO: 2242)

HIF-1α-1874  Target: 5'-CCAGAGTCACTGGAACTTTCTTTTACC-3'    (SEQ ID NO: 3290)

5'-GAGUCACUGGAACUUUCUUUUACca-3'      (SEQ ID NO: 2767)
                     3'-GUCUCAGUGACCUUGAAAGAAAAUGGU-5'    (SEQ ID NO: 2243)

HIF-1α-1875  Target: 5'-CAGAGTCACTGGAACTTTCTTTTACCA-3'    (SEQ ID NO: 3291)

5'-CUGGAACUUUCUUUUACCAUGCCcc-3'      (SEQ ID NO: 2768)
                     3'-GUGACCUUGAAAGAAAAUGGUACGGGG-5'    (SEQ ID NO: 2244)

HIF-1α-1881  Target: 5'-CACTGGAACTTTCTTTTACCATGCCCC-3'    (SEQ ID NO: 3292)

5'-CUAAUAGUCCCAGUGAAUAUUGUtt-3'      (SEQ ID NO: 2769)
                     3'-CGGAUUAUCAGGGUCACUUAUAACAAA-5'    (SEQ ID NO: 2245)

HIF-1α-1966  Target: 5'-GCCTAATAGTCCCAGTGAATATTGTTT-3'    (SEQ ID NO: 3293)

5'-UAAUAGUCCCAGUGAAUAUUGUUtt-3'      (SEQ ID NO: 2770)
                     3'-GGAUUAUCAGGGUCACUUAUAACAAAA-5'    (SEQ ID NO: 2246)

HIF-1α-1967  Target: 5'-CCTAATAGTCCCAGTGAATATTGTTTT-3'    (SEQ ID NO: 3294)

5'-AAUAGUCCCAGUGAAUAUUGUUUtt-3'      (SEQ ID NO: 2771)
                     3'-GAUUAUCAGGGUCACUUAUAACAAAAA-5'    (SEQ ID NO: 2247)

HIF-1α-1968  Target: 5'-CTAATAGTCCCAGTGAATATTGTTTTT-3'    (SEQ ID NO: 3295)

5'-AUAGUCCCAGUGAAUAUUGUUUUta-3'      (SEQ ID NO: 2772)
                     3'-AUUAUCAGGGUCACUUAUAACAAAAAU-5'    (SEQ ID NO: 2248)

HIF-1α-1969  Target: 5'-TAATAGTCCCAGTGAATATTGTTTTTA-3'    (SEQ ID NO: 3296)

5'-UAGUCCCAGUGAAUAUUGUUUUUat-3'      (SEQ ID NO: 2773)
                     3'-UUAUCAGGGUCACUUAUAACAAAAAUA-5'    (SEQ ID NO: 2249)

HIF-1α-1970  Target: 5'-AATAGTCCCAGTGAATATTGTTTTTAT-3'    (SEQ ID NO: 3297)

5'-GUGAAUAUUGUUUUUAUGUGGAUag-3'      (SEQ ID NO: 2774)
                     3'-GUCACUUAUAACAAAAAUACACCUAUC-5'    (SEQ ID NO: 2250)
```

TABLE 2-continued

Selected Anti-HIF-1α DsiRNA Agents (Asymmetrics, HIF-1α)

```
HIF-1α-1978  Target: 5'-CAGTGAATATTGTTTTATGTGGATAG-3'      (SEQ ID NO: 3298)

5'-UGAAUAUUGUUUUAUGUGGAUAgt-3'        (SEQ ID NO: 2775)
                     3'-UCACUUAUAACAAAAAUACACCUAUCA-5'     (SEQ ID NO: 2251)

HIF-1α-1979  Target: 5'-AGTGAATATTGTTTTATGTGGATAGT-3'      (SEQ ID NO: 3299)

5'-AAUAUUGUUUUAUGUGGAUAGUga-3'        (SEQ ID NO: 2776)
                     3'-ACUUAUAACAAAAAUACACCUAUCACU-5'     (SEQ ID NO: 2252)

HIF-1α-1981  Target: 5'-TGAATATTGTTTTATGTGGATAGTGA-3'      (SEQ ID NO: 3300)

5'-UAUUGUUUUAUGUGGAUAGUGAta-3'        (SEQ ID NO: 2777)
                     3'-UUAUAACAAAAAUACACCUAUCACUAU-5'     (SEQ ID NO: 2253)

HIF-1α-1983  Target: 5'-AATATTGTTTTATGTGGATAGTGATA-3'      (SEQ ID NO: 3301)

5'-AUUGUUUUAUGUGGAUAGUGAUat-3'        (SEQ ID NO: 2778)
                     3'-UAUAACAAAAAUACACCUAUCACUAUA-5'     (SEQ ID NO: 2254)

HIF-1α-1984  Target: 5'-ATATTGTTTTATGTGGATAGTGATAT-3'      (SEQ ID NO: 3302)

5'-UGUUUUAUGUGGAUAGUGAUAUgg-3'        (SEQ ID NO: 2779)
                     3'-UAACAAAAAUACACCUAUCACUAUACC-5'     (SEQ ID NO: 2255)

HIF-1α-1986  Target: 5'-ATTGTTTTATGTGGATAGTGATATGG-3'      (SEQ ID NO: 3303)

5'-UUUUAUGUGGAUAGUGAUAUGGUca-3'       (SEQ ID NO: 2780)
                     3'-CAAAAAUACACCUAUCACUAUACCAGU-5'     (SEQ ID NO: 2256)

HIF-1α-1989  Target: 5'-GTTTTATGTGGATAGTGATATGGTCA-3'      (SEQ ID NO: 3304)

5'-UGGAUAGUGAUAUGGUCAAUGAAtt-3'       (SEQ ID NO: 2781)
                     3'-ACACCUAUCACUAUACCAGUUACUUAA-5'     (SEQ ID NO: 2257)

HIF-1α-1996  Target: 5'-TGTGGATAGTGATATGGTCAATGAATT-3'     (SEQ ID NO: 3305)

5'-GAUAGUGAUAUGGUCAAUGAAUUca-3'       (SEQ ID NO: 2782)
                     3'-ACCUAUCACUAUACCAGUUACUUAAGU-5'     (SEQ ID NO: 2258)

HIF-1α-1998  Target: 5'-TGGATAGTGATATGGTCAATGAATTCA-3'     (SEQ ID NO: 3306)

5'-AUAGUGAUAUGGUCAAUGAAUUCaa-3'       (SEQ ID NO: 2783)
                     3'-CCUAUCACUAUACCAGUUACUUAAGUU-5'     (SEQ ID NO: 2259)

HIF-1α-1999  Target: 5'-GGATAGTGATATGGTCAATGAATTCAA-3'     (SEQ ID NO: 3307)

5'-UAGUGAUAUGGUCAAUGAAUUCAag-3'       (SEQ ID NO: 2784)
                     3'-CUAUCACUAUACCAGUUACUUAAGUUC-5'     (SEQ ID NO: 2260)

HIF-1α-2000  Target: 5'-GATAGTGATATGGTCAATGAATTCAAG-3'     (SEQ ID NO: 3308)

5'-GAUAUGGUCAAUGAAUUCAAGUUgg-3'       (SEQ ID NO: 2785)
                     3'-CACUAUACCAGUUACUUAAGUUCAACC-5'     (SEQ ID NO: 2261)

HIF-1α-2004  Target: 5'-GTGATATGGTCAATGAATTCAAGTTGG-3'     (SEQ ID NO: 3309)

5'-AUGGUCAAUGAAUUCAAGUUGGAat-3'       (SEQ ID NO: 2786)
                     3'-UAUACCAGUUACUUAAGUUCAACCUUA-5'     (SEQ ID NO: 2262)

HIF-1α-2007  Target: 5'-ATATGGTCAATGAATTCAAGTTGGAAT-3'     (SEQ ID NO: 3310)

5'-UGGUCAAUGAAUUCAAGUUGGAAtt-3'       (SEQ ID NO: 2787)
                     3'-AUACCAGUUACUUAAGUUCAACCUUAA-5'     (SEQ ID NO: 2263)

HIF-1α-2008  Target: 5'-TATGGTCAATGAATTCAAGTTGGAATT-3'     (SEQ ID NO: 3311)

5'-AAUGAAUUCAAGUUGGAAUUGGUag-3'       (SEQ ID NO: 2788)
                     3'-AGUUACUUAAGUUCAACCUUAACCAUC-5'     (SEQ ID NO: 2264)

HIF-1α-2013  Target: 5'-TCAATGAATTCAAGTTGGAATTGGTAG-3'     (SEQ ID NO: 3312)

5'-AUGAAUUCAAGUUGGAAUUGGUAga-3'       (SEQ ID NO: 2789)
                     3'-GUUACUUAAGUUCAACCUUAACCAUCU-5'     (SEQ ID NO: 2265)
```

TABLE 2-continued

Selected Anti-HIF-1α DsiRNA Agents (Asymmetrics, HIF-1α)

```
HIF-1α-2014  Target: 5'-CAATGAATTCAAGTTGGAATTGGTAGA-3'      (SEQ ID NO: 3313)

5'-GAAUUCAAGUUGGAAUUGGUAGAaa-3'       (SEQ ID NO: 2790)
                     3'-UACUUAAGUUCAACCUUAACCAUCUUU-5'     (SEQ ID NO: 2266)

HIF-1α-2016  Target: 5'-ATGAATTCAAGTTGGAATTGGTAGAAA-3'     (SEQ ID NO: 3314)

5'-AAGUUGGAAUUGGUAGAAAAACUtt-3'       (SEQ ID NO: 2791)
                     3'-AGUUCAACCUUAACCAUCUUUUUGAAA-5'     (SEQ ID NO: 2267)

HIF-1α-2022  Target: 5'-TCAAGTTGGAATTGGTAGAAAAACTTT-3'     (SEQ ID NO: 3315)

5'-GAAUUGGUAGAAAAACUUUUUGCtg-3'       (SEQ ID NO: 2792)
                     3'-ACCUUAACCAUCUUUUUGAAAAACGAC-5'     (SEQ ID NO: 2268)

HIF-1α-2028  Target: 5'-TGGAATTGGTAGAAAAACTTTTTGCTG-3'     (SEQ ID NO: 3316)

5'-AAUUGGUAGAAAAACUUUUUGCUga-3'       (SEQ ID NO: 2793)
                     3'-CCUUAACCAUCUUUUUGAAAAACGACU-5'     (SEQ ID NO: 2269)

HIF-1α-2029  Target: 5'-GGAATTGGTAGAAAAACTTTTTGCTGA-3'     (SEQ ID NO: 3317)

5'-UAGAAAAACUUUUUGCUGAAGACac-3'       (SEQ ID NO: 2794)
                     3'-CCAUCUUUUUGAAAAACGACUUCUGUG-5'     (SEQ ID NO: 2270)

HIF-1α-2035  Target: 5'-GGTAGAAAAACTTTTTGCTGAAGACAC-3'     (SEQ ID NO: 3318)

5'-AGAAAAACUUUUUGCUGAAGACAca-3'       (SEQ ID NO: 2795)
                     3'-CAUCUUUUUGAAAAACGACUUCUGUGU-5'     (SEQ ID NO: 2271)

HIF-1α-2036  Target: 5'-GTAGAAAAACTTTTTGCTGAAGACACA-3'     (SEQ ID NO: 3319)

5'-CUUUUUGCUGAAGACACAGAAGCaa-3'       (SEQ ID NO: 2796)
                     3'-UUGAAAAACGACUUCUGUGUCUUCGUU-5'     (SEQ ID NO: 2272)

HIF-1α-2043  Target: 5'-AACTTTTTGCTGAAGACACAGAAGCAA-3'     (SEQ ID NO: 3320)

5'-CUGAAGACACAGAAGCAAAGAACcc-3'       (SEQ ID NO: 2797)
                     3'-ACGACUUCUGUGUCUUCGUUUCUUGGG-5'     (SEQ ID NO: 2273)

HIF-1α-2050  Target: 5'-TGCTGAAGACACAGAAGCAAAGAACCC-3'     (SEQ ID NO: 3321)

5'-UGAAGACACAGAAGCAAAGAACCca-3'       (SEQ ID NO: 2798)
                     3'-CGACUUCUGUGUCUUCGUUUCUUGGGU-5'     (SEQ ID NO: 2274)

HIF-1α-2051  Target: 5'-GCTGAAGACACAGAAGCAAAGAACCCA-3'     (SEQ ID NO: 3322)

5'-CAGAAGCAAAGAACCCAUUUUCUac-3'       (SEQ ID NO: 2799)
                     3'-GUGUCUUCGUUUCUUGGGUAAAAGAUG-5'     (SEQ ID NO: 2275)

HIF-1α-2059  Target: 5'-CACAGAAGCAAAGAACCCATTTTCTAC-3'     (SEQ ID NO: 3323)

5'-AGAACCCAUUUUCUACUCAGGACac-3'       (SEQ ID NO: 2800)
                     3'-UUUCUUGGGUAAAAGAUGAGUCCUGUG-5'     (SEQ ID NO: 2276)

HIF-1α-2068  Target: 5'-AAAGAACCCATTTTCTACTCAGGACAC-3'     (SEQ ID NO: 3324)

5'-CAGGACACAGAUUUAGACUUGGAga-3'       (SEQ ID NO: 2801)
                     3'-GAGUCCUGUGUCUAAAUCUGAACCUCU-5'     (SEQ ID NO: 2277)

HIF-1α-2085  Target: 5'-CTCAGGACACAGATTTAGACTTGGAGA-3'     (SEQ ID NO: 3325)

5'-CAGAUUUAGACUUGGAGAUGUUAgc-3'       (SEQ ID NO: 2802)
                     3'-GUGUCUAAAUCUGAACCUCUACAAUCG-5'     (SEQ ID NO: 2278)

HIF-1α-2092  Target: 5'-CACAGATTTAGACTTGGAGATGTTAGC-3'     (SEQ ID NO: 3326)

5'-GAUUUAGACUUGGAGAUGUUAGCtc-3'       (SEQ ID NO: 2803)
                     3'-GUCUAAAUCUGAACCUCUACAAUCGAG-5'     (SEQ ID NO: 2279)

HIF-1α-2094  Target: 5'-CAGATTTAGACTTGGAGATGTTAGCTC-3'     (SEQ ID NO: 3327)

5'-AUUUAGACUUGGAGAUGUUAGCUcc-3'       (SEQ ID NO: 2804)
                     3'-UCUAAAUCUGAACCUCUACAAUCGAGG-5'     (SEQ ID NO: 2280)
```

TABLE 2-continued

Selected Anti-HIF-1α DsiRNA Agents (Asymmetrics, HIF-1α)

```
HIF-1α-2095 Target: 5'-AGATTTAGACTTGGAGATGTTAGCTCC-3'     (SEQ ID NO: 3328)

5'-GGAGAUGUUAGCUCCCUAUAUCCca-3'       (SEQ ID NO: 2805)
                    3'-AACCUCUACAAUCGAGGGAUAUAGGGU-5'     (SEQ ID NO: 2281)

HIF-1α-2105 Target: 5'-TTGGAGATGTTAGCTCCCTATATCCCA-3'    (SEQ ID NO: 3329)

5'-AUGAUGACUUCCAGUUACGUUCCtt-3'      (SEQ ID NO: 2806)
                    3'-CCUACUACUGAAGGUCAAUGCAAGGAA-5'    (SEQ ID NO: 2282)

HIF-1α-2134 Target: 5'-GGATGATGACTTCCAGTTACGTTCCTT-3'    (SEQ ID NO: 3330)

5'-CGAUCAGUUGUCACCAUUAGAAAgc-3'      (SEQ ID NO: 2807)
                    3'-AAGCUAGUCAACAGUGGUAAUCUUUCG-5'    (SEQ ID NO: 2283)

HIF-1α-2159 Target: 5'-TTCGATCAGTTGTCACCATTAGAAAGC-3'    (SEQ ID NO: 3331)

5'-UUGUCACCAUUAGAAAGCAGUUCcg-3'      (SEQ ID NO: 2808)
                    3'-UCAACAGUGGUAAUCUUUCGUCAAGGC-5'    (SEQ ID NO: 2284)

HIF-1α-2166 Target: 5'-AGTTGTCACCATTAGAAAGCAGTTCCG-3'    (SEQ ID NO: 3332)

5'-CAGUUACAGUAUUCCAGCAGACUca-3'      (SEQ ID NO: 2809)
                    3'-GUGUCAAUGUCAUAAGGUCGUCUGAGU-5'    (SEQ ID NO: 2285)

HIF-1α-2221 Target: 5'-CACAGTTACAGTATTCCAGCAGACTCA-3'    (SEQ ID NO: 3333)

5'-GAAUUAAAAACAGUGACAAAAGAcc-3'      (SEQ ID NO: 2810)
                    3'-UACUUAAUUUUUGUCACUGUUUUCUGG-5'    (SEQ ID NO: 2286)

HIF-1α-2295 Target: 5'-ATGAATTAAAAACAGTGACAAAAGACC-3'    (SEQ ID NO: 3334)

5'-AAUUAAAAACAGUGACAAAAGACcg-3'      (SEQ ID NO: 2811)
                    3'-ACUUAAUUUUUGUCACUGUUUUCUGGC-5'    (SEQ ID NO: 2287)

HIF-1α-2296 Target: 5'-TGAATTAAAAACAGTGACAAAAGACCG-3'    (SEQ ID NO: 3335)

5'-AUUAAAAACAGUGACAAAAGACCgt-3'      (SEQ ID NO: 2812)
                    3'-CUUAAUUUUUGUCACUGUUUUCUGGCA-5'    (SEQ ID NO: 2288)

HIF-1α-2297 Target: 5'-GAATTAAAAACAGTGACAAAAGACCGT-3'    (SEQ ID NO: 3336)

5'-CAGUGACAAAAGACCGUAUGGAAga-3'      (SEQ ID NO: 2813)
                    3'-UUGUCACUGUUUUCUGGCAUACCUUCU-5'    (SEQ ID NO: 2289)

HIF-1α-2305 Target: 5'-AACAGTGACAAAAGACCGTATGGAAGA-3'    (SEQ ID NO: 3337)

5'-GUGACAAAAGACCGUAUGGAAGAca-3'      (SEQ ID NO: 2814)
                    3'-GUCACUGUUUUCUGGCAUACCUUCUGU-5'    (SEQ ID NO: 2290)

HIF-1α-2307 Target: 5'-CAGTGACAAAAGACCGTATGGAAGACA-3'    (SEQ ID NO: 3338)

5'-CGUAUGGAAGACAUUAAAAUAUUga-3'      (SEQ ID NO: 2815)
                    3'-UGGCAUACCUUCUGUAAUUUUAUAACU-5'    (SEQ ID NO: 2291)

HIF-1α-2319 Target: 5'-ACCGTATGGAAGACATTAAAATATTGA-3'    (SEQ ID NO: 3339)

5'-AUGGAAGACAUUAAAAUAUUGAUtg-3'      (SEQ ID NO: 2816)
                    3'-CAUACCUUCUGUAAUUUUAUAACUAAC-5'    (SEQ ID NO: 2292)

HIF-1α-2322 Target: 5'-GTATGGAAGACATTAAAATATTGATTG-3'    (SEQ ID NO: 3340)

5'-UGGAAGACAUUAAAAUAUUGAUUgc-3'      (SEQ ID NO: 2817)
                    3'-AUACCUUCUGUAAUUUUAUAACUAACG-5'    (SEQ ID NO: 2293)

HIF-1α-2323 Target: 5'-TATGGAAGACATTAAAATATTGATTGC-3'    (SEQ ID NO: 3341)

5'-GAAGACAUUAAAAUAUUGAUUGCat-3'      (SEQ ID NO: 2818)
                    3'-ACCUUCUGUAAUUUUAUAACUAACGUA-5'    (SEQ ID NO: 2294)

HIF-1α-2325 Target: 5'-TGGAAGACATTAAAATATTGATTGCAT-3'    (SEQ ID NO: 3342)

5'-AUAGAGAUACUCAAAGUCGGACAgc-3'      (SEQ ID NO: 2819)
                    3'-UAUAUCUCUAUGAGUUUCAGCCUGUCG-5'    (SEQ ID NO: 2295)
```

TABLE 2-continued

Selected Anti-HIF-1α DsiRNA Agents (Asymmetrics, HIF-1α)

```
HIF-1α-2404 Target: 5'-ATATAGAGATACTCAAAGTCGGACAGC-3'       (SEQ ID NO: 3343)

5'-GAAAAGGAGUCAUAGAACAGACAga-3'         (SEQ ID NO: 2820)
                    3'-UCCUUUUCCUCAGUAUCUUGUCUGUCU-5'       (SEQ ID NO: 2296)

HIF-1α-2446 Target: 5'-AGGAAAAGGAGTCATAGAACAGACAGA-3'       (SEQ ID NO: 3344)

5'-AGGAGUCAUAGAACAGACAGAAAaa-3'         (SEQ ID NO: 2821)
                    3'-UUUCCUCAGUAUCUUGUCUGUCUUUUU-5'       (SEQ ID NO: 2297)

HIF-1α-2450 Target: 5'-AAAGGAGTCATAGAACAGACAGAAAAA-3'       (SEQ ID NO: 3345)

5'-GGAGUCAUAGAACAGACAGAAAAat-3'         (SEQ ID NO: 2822)
                    3'-UUCCUCAGUAUCUUGUCUGUCUUUUUA-5'       (SEQ ID NO: 2298)

HIF-1α-2451 Target: 5'-AAGGAGTCATAGAACAGACAGAAAAAT-3'       (SEQ ID NO: 3346)

5'-CAGAAAAAUCUCAUCCAAGAAGCcc-3'         (SEQ ID NO: 2823)
                    3'-CUGUCUUUUUAGAGUAGGUUCUUCGGG-5'       (SEQ ID NO: 2299)

HIF-1α-2467 Target: 5'-GACAGAAAAATCTCATCCAAGAAGCCC-3'       (SEQ ID NO: 3347)

5'-AGAAAAAUCUCAUCCAAGAAGCCct-3'         (SEQ ID NO: 2824)
                    3'-UGUCUUUUUAGAGUAGGUUCUUCGGGA-5'       (SEQ ID NO: 2300)

HIF-1α-2468 Target: 5'-ACAGAAAAATCTCATCCAAGAAGCCCT-3'       (SEQ ID NO: 3348)

5'-CGUGUUAUCUGUCGCUUUGAGUCaa-3'         (SEQ ID NO: 2825)
                    3'-UUGCACAAUAGACAGCGAAACUCAGUU-5'       (SEQ ID NO: 2301)

HIF-1α-2495 Target: 5'-AACGTGTTATCTGTCGCTTTGAGTCAA-3'       (SEQ ID NO: 3349)

5'-GUGUUAUCUGUCGCUUUGAGUCAaa-3'         (SEQ ID NO: 2826)
                    3'-UGCACAAUAGACAGCGAAACUCAGUUU-5'       (SEQ ID NO: 2302)

HIF-1α-2496 Target: 5'-ACGTGTTATCTGTCGCTTTGAGTCAAA-3'       (SEQ ID NO: 3350)

5'-CUGUCGCUUUGAGUCAAAGAACUac-3'         (SEQ ID NO: 2827)
                    3'-UAGACAGCGAAACUCAGUUUCUUGAUG-5'       (SEQ ID NO: 2303)

HIF-1α-2503 Target: 5'-ATCTGTCGCTTTGAGTCAAAGAACTAC-3'       (SEQ ID NO: 3351)

5'-UUUGAGUCAAAGAACUACAGUUCct-3'         (SEQ ID NO: 2828)
                    3'-CGAAACUCAGUUUCUUGAUGUCAAGGA-5'       (SEQ ID NO: 2304)

HIF-1α-2510 Target: 5'-GCTTTGAGTCAAAGAACTACAGTTCCT-3'       (SEQ ID NO: 3352)

5'-UUGAGUCAAAGAACUACAGUUCCtg-3'         (SEQ ID NO: 2829)
                    3'-GAAACUCAGUUUCUUGAUGUCAAGGAC-5'       (SEQ ID NO: 2305)

HIF-1α-2511 Target: 5'-CTTTGAGTCAAAGAACTACAGTTCCTG-3'       (SEQ ID NO: 3353)

5'-CAAAGAACUACAGUUCCUGAGGAag-3'         (SEQ ID NO: 2830)
                    3'-CAGUUUCUUGAUGUCAAGGACUCCUUC-5'       (SEQ ID NO: 2306)

HIF-1α-2517 Target: 5'-GTCAAAGAACTACAGTTCCTGAGGAAG-3'       (SEQ ID NO: 3354)

5'-AAAGAACUACAGUUCCUGAGGAAga-3'         (SEQ ID NO: 2831)
                    3'-AGUUUCUUGAUGUCAAGGACUCCUUCU-5'       (SEQ ID NO: 2307)

HIF-1α-2518 Target: 5'-TCAAAGAACTACAGTTCCTGAGGAAGA-3'       (SEQ ID NO: 3355)

5'-GAGGAAGAACUAAAUCCAAAGAUac-3'         (SEQ ID NO: 2832)
                    3'-GACUCCUUCUUGAUUUAGGUUUCUAUG-5'       (SEQ ID NO: 2308)

HIF-1α-2535 Target: 5'-CTGAGGAAGAACTAAATCCAAAGATAC-3'       (SEQ ID NO: 3356)

5'-AGGAAGAACUAAAUCCAAAGAUAct-3'         (SEQ ID NO: 2833)
                    3'-ACUCCUUCUUGAUUUAGGUUUCUAUGA-5'       (SEQ ID NO: 2309)

HIF-1α-2536 Target: 5'-TGAGGAAGAACTAAATCCAAAGATACT-3'       (SEQ ID NO: 3357)

5'-GGAAGAACUAAAUCCAAAGAUACta-3'         (SEQ ID NO: 2834)
                    3'-CUCCUUCUUGAUUUAGGUUUCUAUGAU-5'       (SEQ ID NO: 2310)
```

TABLE 2-continued

Selected Anti-HIF-1α DsiRNA Agents (Asymmetrics, HIF-1α)

```
HIF-1α-2537  Target: 5'-GAGGAAGAACTAAATCCAAAGATACTA-3'    (SEQ ID NO: 3358)

5'-GAAGAACUAAAUCCAAAGAUACUag-3'      (SEQ ID NO: 2835)
                     3'-UCCUUCUUGAUUUAGGUUUCUAUGAUC-5'    (SEQ ID NO: 2311)

HIF-1α-2538  Target: 5'-AGGAAGAACTAAATCCAAAGATACTAG-3'   (SEQ ID NO: 3359)

5'-AAAUCCAAAGAUACUAGCUUUGCag-3'      (SEQ ID NO: 2836)
                     3'-GAUUUAGGUUUCUAUGAUCGAAACGUC-5'    (SEQ ID NO: 2312)

HIF-1α-2546  Target: 5'-CTAAATCCAAAGATACTAGCTTTGCAG-3'   (SEQ ID NO: 3360)

5'-CAAAGAUACUAGCUUUGCAGAAUgc-3'      (SEQ ID NO: 2837)
                     3'-AGGUUUCUAUGAUCGAAACGUCUUACG-5'    (SEQ ID NO: 2313)

HIF-1α-2551  Target: 5'-TCCAAAGATACTAGCTTTGCAGAATGC-3'   (SEQ ID NO: 3361)

5'-AAGAUACUAGCUUUGCAGAAUGCuc-3'      (SEQ ID NO: 2838)
                     3'-GUUUCUAUGAUCGAAACGUCUUACGAG-5'    (SEQ ID NO: 2314)

HIF-1α-2553  Target: 5'-CAAAGATACTAGCTTTGCAGAATGCTC-3'   (SEQ ID NO: 3362)

5'-AGAUACUAGCUUUGCAGAAUGCUca-3'      (SEQ ID NO: 2839)
                     3'-UUUCUAUGAUCGAAACGUCUUACGAGU-5'    (SEQ ID NO: 2315)

HIF-1α-2554  Target: 5'-AAAGATACTAGCTTTGCAGAATGCTCA-3'   (SEQ ID NO: 3363)

5'-GAAAGCGAAAAAUGGAACAUGAUgg-3'      (SEQ ID NO: 2840)
                     3'-CUCUUUCGCUUUUUACCUUGUACUACC-5'    (SEQ ID NO: 2316)

HIF-1α-2581  Target: 5'-GAGAAAGCGAAAAATGGAACATGATGG-3'   (SEQ ID NO: 3364)

5'-UGGAACAUGAUGGUUCACUUUUUca-3'      (SEQ ID NO: 2841)
                     3'-UUACCUUGUACUACCAAGUGAAAAAGU-5'    (SEQ ID NO: 2317)

HIF-1α-2593  Target: 5'-AATGGAACATGATGGTTCACTTTTTCA-3'   (SEQ ID NO: 3365)

5'-AUGAUGGUUCACUUUUUCAAGCAgt-3'      (SEQ ID NO: 2842)
                     3'-UGUACUACCAAGUGAAAAAGUUCGUCA-5'    (SEQ ID NO: 2318)

HIF-1α-2599  Target: 5'-ACATGATGGTTCACTTTTTCAAGCAGT-3'   (SEQ ID NO: 3366)

5'-UUUUUCAAGCAGUAGGAAUUGGAac-3'      (SEQ ID NO: 2843)
                     3'-UGAAAAAGUUCGUCAUCCUUAACCUUG-5'    (SEQ ID NO: 2319)

HIF-1α-2611  Target: 5'-ACTTTTTCAAGCAGTAGGAATTGGAAC-3'   (SEQ ID NO: 3367)

5'-CAGUAGGAAUUGGAACAUUAUUAca-3'      (SEQ ID NO: 2844)
                     3'-UCGUCAUCCUUAACCUUGUAAUAAUGU-5'    (SEQ ID NO: 2320)

HIF-1α-2620  Target: 5'-AGCAGTAGGAATTGGAACATTATTACA-3'   (SEQ ID NO: 3368)

5'-AGUAGGAAUUGGAACAUUAUUACag-3'      (SEQ ID NO: 2845)
                     3'-CGUCAUCCUUAACCUUGUAAUAAUGUC-5'    (SEQ ID NO: 2321)

HIF-1α-2621  Target: 5'-GCAGTAGGAATTGGAACATTATTACAG-3'   (SEQ ID NO: 3369)

5'-GUAGGAAUUGGAACAUUAUUACAgc-3'      (SEQ ID NO: 2846)
                     3'-GUCAUCCUUAACCUUGUAAUAAUGUCG-5'    (SEQ ID NO: 2322)

HIF-1α-2622  Target: 5'-CAGTAGGAATTGGAACATTATTACAGC-3'   (SEQ ID NO: 3370)

5'-CUUGGAAACGUGUAAAAGGAUGCaa-3'      (SEQ ID NO: 2847)
                     3'-AAGAACCUUUGCACAUUUUCCUACGUU-5'    (SEQ ID NO: 2323)

HIF-1α-2680  Target: 5'-TTCTTGGAAACGTGTAAAAGGATGCAA-3'   (SEQ ID NO: 3371)

5'-UUGGAAACGUGUAAAAGGAUGCAaa-3'      (SEQ ID NO: 2848)
                     3'-AGAACCUUUGCACAUUUUCCUACGUUU-5'    (SEQ ID NO: 2324)

HIF-1α-2681  Target: 5'-TCTTGGAAACGTGTAAAAGGATGCAAA-3'   (SEQ ID NO: 3372)

5'-UAAAAGGAUGCAAAUCUAGUGAAca-3'      (SEQ ID NO: 2849)
                     3'-ACAUUUUCCUACGUUUAGAUCACUUGU-5'    (SEQ ID NO: 2325)
```

TABLE 2-continued

Selected Anti-HIF-1α DsiRNA Agents (Asymmetrics, HIF-1α)

```
HIF-1α-2692  Target: 5'-TGTAAAAGGATGCAAATCTAGTGAACA-3'      (SEQ ID NO: 3373)

5'-AAAAGGAUGCAAAUCUAGUGAACAg-3'         (SEQ ID NO: 2850)
                    3'-CAUUUUCCUACGUUUAGAUCACUUGUC-5'       (SEQ ID NO: 2326)

HIF-1α-2693  Target: 5'-GTAAAAGGATGCAAATCTAGTGAACAG-3'     (SEQ ID NO: 3374)

5'-GAUGCAAAUCUAGUGAACAGAAUgg-3'         (SEQ ID NO: 2851)
                    3'-UCCUACGUUUAGAUCACUUGUCUUACC-5'       (SEQ ID NO: 2327)

HIF-1α-2698  Target: 5'-AGGATGCAAATCTAGTGAACAGAATGG-3'     (SEQ ID NO: 3375)

5'-CAAAUCUAGUGAACAGAAUGGAAtg-3'         (SEQ ID NO: 2852)
                    3'-ACGUUUAGAUCACUUGUCUUACCUUAC-5'       (SEQ ID NO: 2328)

HIF-1α-2702  Target: 5'-TGCAAATCTAGTGAACAGAATGGAATG-3'     (SEQ ID NO: 3376)

5'-UAGUGAACAGAAUGGAAUGGAGCaa-3'         (SEQ ID NO: 2853)
                    3'-AGAUCACUUGUCUUACCUUACCUCGUU-5'       (SEQ ID NO: 2329)

HIF-1α-2708  Target: 5'-TCTAGTGAACAGAATGGAATGGAGCAA-3'     (SEQ ID NO: 3377)

5'-AGUGAACAGAAUGGAAUGGAGCAaa-3'         (SEQ ID NO: 2854)
                    3'-GAUCACUUGUCUUACCUUACCUCGUUU-5'       (SEQ ID NO: 2330)

HIF-1α-2709  Target: 5'-CTAGTGAACAGAATGGAATGGAGCAAA-3'     (SEQ ID NO: 3378)

5'-AGAAUGGAAUGGAGCAAAAGACAat-3'         (SEQ ID NO: 2855)
                    3'-UGUCUUACCUUACCUCGUUUUCUGUUA-5'       (SEQ ID NO: 2331)

HIF-1α-2716  Target: 5'-ACAGAATGGAATGGAGCAAAAGACAAT-3'     (SEQ ID NO: 3379)

5'-GGAAUGGAGCAAAAGACAAUUAUtt-3'         (SEQ ID NO: 2856)
                    3'-UACCUUACCUCGUUUUCUGUUAAUAAA-5'       (SEQ ID NO: 2332)

HIF-1α-2721  Target: 5'-ATGGAATGGAGCAAAAGACAATTATTT-3'     (SEQ ID NO: 3380)

5'-AAUGGAGCAAAAGACAAUUAUUUta-3'         (SEQ ID NO: 2857)
                    3'-CCUUACCUCGUUUUCUGUUAAUAAAAU-5'       (SEQ ID NO: 2333)

HIF-1α-2723  Target: 5'-GGAATGGAGCAAAAGACAATTATTTTA-3'     (SEQ ID NO: 3381)

5'-AUGGAGCAAAAGACAAUUAUUUUaa-3'         (SEQ ID NO: 2858)
                    3'-CUUACCUCGUUUUCUGUUAAUAAAAUU-5'       (SEQ ID NO: 2334)

HIF-1α-2724  Target: 5'-GAATGGAGCAAAAGACAATTATTTTAA-3'     (SEQ ID NO: 3382)

5'-UGGAGCAAAAGACAAUUAUUUUAat-3'         (SEQ ID NO: 2859)
                    3'-UUACCUCGUUUUCUGUUAAUAAAAUUA-5'       (SEQ ID NO: 2335)

HIF-1α-2725  Target: 5'-AATGGAGCAAAAGACAATTATTTTAAT-3'     (SEQ ID NO: 3383)

5'-GGAGCAAAAGACAAUUAUUUUAAta-3'         (SEQ ID NO: 2860)
                    3'-UACCUCGUUUUCUGUUAAUAAAAUUAU-5'       (SEQ ID NO: 2336)

HIF-1α-2726  Target: 5'-ATGGAGCAAAAGACAATTATTTTAATA-3'     (SEQ ID NO: 3384)

5'-AAUUAUUUUAAUACCCUCUGAUUta-3'         (SEQ ID NO: 2861)
                    3'-UGUUAAUAAAAUUAUGGGAGACUAAAU-5'       (SEQ ID NO: 2337)

HIF-1α-2738  Target: 5'-ACAATTATTTTAATACCCTCTGATTTA-3'     (SEQ ID NO: 3385)

5'-AUUAUUUUAAUACCCUCUGAUUUag-3'         (SEQ ID NO: 2862)
                    3'-GUUAAUAAAAUUAUGGGAGACUAAAUC-5'       (SEQ ID NO: 2338)

HIF-1α-2739  Target: 5'-CAATTATTTTAATACCCTCTGATTTAG-3'     (SEQ ID NO: 3386)

5'-UUAUUUUAAUACCCUCUGAUUUAgc-3'         (SEQ ID NO: 2863)
                    3'-UUAAUAAAAUUAUGGGAGACUAAAUCG-5'       (SEQ ID NO: 2339)

HIF-1α-2740  Target: 5'-AATTATTTTAATACCCTCTGATTTAGC-3'     (SEQ ID NO: 3387)

5'-AUUUUAAUACCCUCUGAUUUAGCat-3'         (SEQ ID NO: 2864)
                    3'-AAUAAAAUUAUGGGAGACUAAAUCGUA-5'       (SEQ ID NO: 2340)
```

TABLE 2-continued

Selected Anti-HIF-1α DsiRNA Agents (Asymmetrics, HIF-1α)

```
HIF-1α-2742  Target: 5'-TTATTTTAATACCCTCTGATTTAGCAT-3'     (SEQ ID NO: 3388)

5'-UUUUAAUACCCUCUGAUUUAGCAtg-3'       (SEQ ID NO: 2865)
                     3'-AUAAAAUUAUGGGAGACUAAAUCGUAC-5'     (SEQ ID NO: 2341)

HIF-1α-2743  Target: 5'-TATTTTAATACCCTCTGATTTAGCATG-3'     (SEQ ID NO: 3389)

5'-UGGGGCAAUCAAUGGAUGAAAGUgg-3'       (SEQ ID NO: 2866)
                     3'-CGACCCCGUUAGUUACCUACUUUCACC-5'     (SEQ ID NO: 2342)

HIF-1α-2776  Target: 5'-GCTGGGGCAATCAATGGATGAAAGTGG-3'     (SEQ ID NO: 3390)

5'-CAAUCAAUGGAUGAAAGUGGAUUac-3'       (SEQ ID NO: 2867)
                     3'-CCGUUAGUUACCUACUUUCACCUAAUG-5'     (SEQ ID NO: 2343)

HIF-1α-2781  Target: 5'-GGCAATCAATGGATGAAAGTGGATTAC-3'     (SEQ ID NO: 3391)

5'-AGUUAUGAUUGUGAAGUUAAUGCtc-3'       (SEQ ID NO: 2868)
                     3'-GGUCAAUACUAACACUUCAAUUACGAG-5'     (SEQ ID NO: 2344)

HIF-1α-2817  Target: 5'-CCAGTTATGATTGTGAAGTTAATGCTC-3'     (SEQ ID NO: 3392)

5'-GUUAUGAUUGUGAAGUUAAUGCUcc-3'       (SEQ ID NO: 2869)
                     3'-GUCAAUACUAACACUUCAAUUACGAGG-5'     (SEQ ID NO: 2345)

HIF-1α-2818  Target: 5'-CAGTTATGATTGTGAAGTTAATGCTCC-3'     (SEQ ID NO: 3393)

5'-UGUGAAGUUAAUGCUCCUAUACAag-3'       (SEQ ID NO: 2870)
                     3'-UAACACUUCAAUUACGAGGAUAUGUUC-5'     (SEQ ID NO: 2346)

HIF-1α-2826  Target: 5'-ATTGTGAAGTTAATGCTCCTATACAAG-3'     (SEQ ID NO: 3394)

5'-AAGUUAAUGCUCCUAUACAAGGCag-3'       (SEQ ID NO: 2871)
                     3'-ACUUCAAUUACGAGGAUAUGUUCCGUC-5'     (SEQ ID NO: 2347)

HIF-1α-2830  Target: 5'-TGAAGTTAATGCTCCTATACAAGGCAG-3'     (SEQ ID NO: 3395)

5'-AGGGUGAAGAAUUACUCAGAGCUtt-3'       (SEQ ID NO: 2872)
                     3'-CGUCCCACUUCUUAAUGAGUCUCGAAA-5'     (SEQ ID NO: 2348)

HIF-1α-2869  Target: 5'-GCAGGGTGAAGAATTACTCAGAGCTTT-3'     (SEQ ID NO: 3396)

5'-AAGAAUUACUCAGAGCUUUGGAUca-3'       (SEQ ID NO: 2873)
                     3'-ACUUCUUAAUGAGUCUCGAAACCUAGU-5'     (SEQ ID NO: 2349)

HIF-1α-2875  Target: 5'-TGAAGAATTACTCAGAGCTTTGGATCA-3'     (SEQ ID NO: 3397)

5'-GAAUUACUCAGAGCUUUGGAUCAag-3'       (SEQ ID NO: 2874)
                     3'-UUCUUAAUGAGUCUCGAAACCUAGUUC-5'     (SEQ ID NO: 2350)

HIF-1α-2877  Target: 5'-AAGAATTACTCAGAGCTTTGGATCAAG-3'     (SEQ ID NO: 3398)

5'-CAGAGCUUUGGAUCAAGUUAACUga-3'       (SEQ ID NO: 2875)
                     3'-GAGUCUCGAAACCUAGUUCAAUUGACU-5'     (SEQ ID NO: 2351)

HIF-1α-2885  Target: 5'-CTCAGAGCTTTGGATCAAGTTAACTGA-3'     (SEQ ID NO: 3399)

5'-AGUUAACUGAGCUUUUUCUUAAUtt-3'       (SEQ ID NO: 2876)
                     3'-GUUCAAUUGACUCGAAAAAGAAUUAAA-5'     (SEQ ID NO: 2352)

HIF-1α-2900  Target: 5'-CAAGTTAACTGAGCTTTTCTTAATTT-3'      (SEQ ID NO: 3400)

5'-UUAACUGAGCUUUUUCUUAAUUUca-3'       (SEQ ID NO: 2877)
                     3'-UCAAUUGACUCGAAAAAGAAUUAAAGU-5'     (SEQ ID NO: 2353)

HIF-1α-2902  Target: 5'-AGTTAACTGAGCTTTTCTTAATTTCA-3'      (SEQ ID NO: 3401)

5'-UUUUCUUAAUUUCAUUCCUUUUUtt-3'       (SEQ ID NO: 2878)
                     3'-GAAAAGAAUUAAAGUAAGGAAAAAAA-5'      (SEQ ID NO: 2354)

HIF-1α-2913  Target: 5'-CTTTTTCTTAATTTCATTCCTTTTTTT-3'     (SEQ ID NO: 3402)

5'-UUAAUUUCAUUCCUUUUUUGGAca-3'        (SEQ ID NO: 2879)
                     3'-AGAAUUAAAGUAAGGAAAAAAACCUGU-5'     (SEQ ID NO: 2355)
```

TABLE 2-continued

Selected Anti-HIF-1α DsiRNA Agents (Asymmetrics, HIF-1α)

```
HIF-1α-2918  Target: 5'-TCTTAATTTCATTCCTTTTTTGGACA-3'      (SEQ ID NO: 3403)

5'-AAUUUCAUUCCUUUUUUGGACAct-3'        (SEQ ID NO: 2880)
                     3'-AAUUAAAGUAAGGAAAAAAACCUGUGA-5'     (SEQ ID NO: 2356)

HIF-1α-2920  Target: 5'-TTAATTTCATTCCTTTTTTGGACACT-3'      (SEQ ID NO: 3404)

5'-CUGGUGGCUCAUUACCUAAAGCAgt-3'       (SEQ ID NO: 2881)
                     3'-GUGACCACCGAGUAAUGGAUUUCGUCA-5'     (SEQ ID NO: 2357)

HIF-1α-2943  Target: 5'-CACTGGTGGCTCATTACCTAAAGCAGT-3'     (SEQ ID NO: 3405)

5'-CAUUACCUAAAGCAGUCUAUUUAta-3'       (SEQ ID NO: 2882)
                     3'-GAGUAAUGGAUUUCGUCAGAUAAAUAU-5'     (SEQ ID NO: 2358)

HIF-1α-2952  Target: 5'-CTCATTACCTAAAGCAGTCTATTTATA-3'     (SEQ ID NO: 3406)

5'-AUUACCUAAAGCAGUCUAUUUAUat-3'       (SEQ ID NO: 2883)
                     3'-AGUAAUGGAUUUCGUCAGAUAAAUAUA-5'    (SEQ ID NO: 2359)

HIF-1α-2953  Target: 5'-TCATTACCTAAAGCAGTCTATTTATAT-3'     (SEQ ID NO: 3407)

5'-CUAAAGCAGUCUAUUUAUAUUUUct-3'       (SEQ ID NO: 2884)
                     3'-UGGAUUUCGUCAGAUAAAUAUAAAAGA-5'    (SEQ ID NO: 2360)

HIF-1α-2958  Target: 5'-ACCTAAAGCAGTCTATTTATATTTTCT-3'     (SEQ ID NO: 3408)

5'-AAAGCAGUCUAUUUAUAUUUUCUac-3'       (SEQ ID NO: 2885)
                     3'-GAUUUCGUCAGAUAAAUAUAAAAGAUG-5'    (SEQ ID NO: 2361)

HIF-1α-2960  Target: 5'-CTAAAGCAGTCTATTTATATTTTCTAC-3'     (SEQ ID NO: 3409)

5'-UUUAUAUUUUCUACAUCUAAUUUUta-3'      (SEQ ID NO: 2886)
                     3'-AUAAAUAUAAAAGAUGUAGAUUAAAAU-5'    (SEQ ID NO: 2362)

HIF-1α-2971  Target: 5'-TATTTATATTTTCTACATCTAATTTTA-3'     (SEQ ID NO: 3410)

5'-UUUAUAUUUUCUACAUCUAAUUUUag-3'      (SEQ ID NO: 2887)
                     3'-UAAAUAUAAAAGAUGUAGAUUAAAAUC-5'    (SEQ ID NO: 2363)

HIF-1α-2972  Target: 5'-ATTTATATTTTCTACATCTAATTTTAG-3'     (SEQ ID NO: 3411)

5'-UAUAUUUUCUACAUCUAAUUUUAga-3'       (SEQ ID NO: 2888)
                     3'-AAAUAUAAAAGAUGUAGAUUAAAAUCU-5'    (SEQ ID NO: 2364)

HIF-1α-2973  Target: 5'-TTTATATTTTCTACATCTAATTTTAGA-3'     (SEQ ID NO: 3412)

5'-UAUUUUCUACAUCUAAUUUUAGAag-3'       (SEQ ID NO: 2889)
                     3'-AUAUAAAAGAUGUAGAUUAAAAUCUUC-5'    (SEQ ID NO: 2365)

HIF-1α-2975  Target: 5'-TATATTTTCTACATCTAATTTTAGAAG-3'     (SEQ ID NO: 3413)

5'-AUUUUCUACAUCUAAUUUUAGAAgc-3'       (SEQ ID NO: 2890)
                     3'-UAUAAAAGAUGUAGAUUAAAAUCUUCG-5'    (SEQ ID NO: 2366)

HIF-1α-2976  Target: 5'-ATATTTTCTACATCTAATTTTAGAAGC-3'     (SEQ ID NO: 3414)

5'-CUGGCUACAAUACUGCACAAACUtg-3'       (SEQ ID NO: 2891)
                     3'-CGGACCGAUGUUAUGACGUGUUUGAAC-5'    (SEQ ID NO: 2367)

HIF-1α-3001  Target: 5'-GCCTGGCTACAATACTGCACAAACTTG-3'     (SEQ ID NO: 3415)

5'-CUUGGUUAGUUCAAUUUUGAUCCcc-3'       (SEQ ID NO: 2892)
                     3'-UUGAACCAAUCAAGUUAAAACUAGGGG-5'    (SEQ ID NO: 2368)

HIF-1α-3022  Target: 5'-AACTTGGTTAGTTCAATTTTGATCCCC-3'     (SEQ ID NO: 3416)

5'-AGUUCAAUUUUGAUCCCCUUUCUac-3'       (SEQ ID NO: 2893)
                     3'-AAUCAAGUUAAAACUAGGGGAAAGAUG-5'    (SEQ ID NO: 2369)

HIF-1α-3029  Target: 5'-TTAGTTCAATTTTGATCCCCTTTCTAC-3'     (SEQ ID NO: 3417)

5'-UUUGAUCCCCUUUCUACUUAAUUta-3'       (SEQ ID NO: 2894)
                     3'-UAAAACUAGGGGAAAGAUGAAUUAAAU-5'    (SEQ ID NO: 2370)
```

TABLE 2-continued

Selected Anti-HIF-1α DsiRNA Agents (Asymmetrics, HIF-1α)

```
HIF-1α-3037  Target: 5'-ATTTTGATCCCCTTTCTACTTAATTTA-3'      (SEQ ID NO: 3418)

5'-UUGAUCCCCUUUCUACUUAAUUUac-3'         (SEQ ID NO: 2895)
                     3'-AAAACUAGGGGAAAGAUGAAUUAAAUG-5'       (SEQ ID NO: 2371)

HIF-1α-3038  Target: 5'-TTTTGATCCCCTTTCTACTTAATTTAC-3'      (SEQ ID NO: 3419)

5'-UGAUCCCCUUUCUACUUAAUUUAca-3'         (SEQ ID NO: 2896)
                     3'-AAACUAGGGGAAAGAUGAAUUAAAUGU-5'       (SEQ ID NO: 2372)

HIF-1α-3039  Target: 5'-TTTGATCCCCTTTCTACTTAATTTACA-3'      (SEQ ID NO: 3420)

5'-CUUUCUACUUAAUUUACAUUAAUgc-3'         (SEQ ID NO: 2897)
                     3'-GGGAAAGAUGAAUUAAAUGUAAUUACG-5'       (SEQ ID NO: 2373)

HIF-1α-3046  Target: 5'-CCCTTTCTACTTAATTTACATTAATGC-3'      (SEQ ID NO: 3421)

5'-AAUUUACAUUAAUGCUCUUUUUUag-3'         (SEQ ID NO: 2898)
                     3'-AAUUAAAUGUAAUUACGAGAAAAAAUC-5'       (SEQ ID NO: 2374)

HIF-1α-3056  Target: 5'-TTAATTTACATTAATGCTCTTTTTTAG-3'      (SEQ ID NO: 3422)

5'-AUUUACAUUAAUGCUCUUUUUUAgt-3'         (SEQ ID NO: 2899)
                     3'-AUUAAAUGUAAUUACGAGAAAAAAUCA-5'       (SEQ ID NO: 2375)

HIF-1α-3057  Target: 5'-TAATTTACATTAATGCTCTTTTTTAGT-3'      (SEQ ID NO: 3423)

5'-AUUAAUGCUCUUUUUUAGUAUGUtc-3'         (SEQ ID NO: 2900)
                     3'-UGUAAUUACGAGAAAAAAUCAUACAAG-5'       (SEQ ID NO: 2376)

HIF-1α-3063  Target: 5'-ACATTAATGCTCTTTTTTAGTATGTTC-3'      (SEQ ID NO: 3424)

5'-UUAAUGCUCUUUUUUAGUAUGUUct-3'         (SEQ ID NO: 2901)
                     3'-GUAAUUACGAGAAAAAAUCAUACAAGA-5'       (SEQ ID NO: 2377)

HIF-1α-3064  Target: 5'-CATTAATGCTCTTTTTTAGTATGTTCT-3'      (SEQ ID NO: 3425)

5'-AAUGCUCUUUUUUAGUAUGUUCUtt-3'         (SEQ ID NO: 2902)
                     3'-AAUUACGAGAAAAAAUCAUACAAGAAA-5'       (SEQ ID NO: 2378)

HIF-1α-3066  Target: 5'-TTAATGCTCTTTTTTAGTATGTTCTTT-3'      (SEQ ID NO: 3426)

5'-UUUUUAGUAUGUUCUUUAAUGCUgg-3'         (SEQ ID NO: 2903)
                     3'-GAAAAAAUCAUACAAGAAAUUACGACC-5'       (SEQ ID NO: 2379)

HIF-1α-3074  Target: 5'-CTTTTTTAGTATGTTCTTTAATGCTGG-3'      (SEQ ID NO: 3427)

5'-UAGUAUGUUCUUUAAUGCUGGAUca-3'         (SEQ ID NO: 2904)
                     3'-AAAUCAUACAAGAAAUUACGACCUAGU-5'       (SEQ ID NO: 2380)

HIF-1α-3078  Target: 5'-TTTAGTATGTTCTTTAATGCTGGATCA-3'      (SEQ ID NO: 3428)

5'-AGUAUGUUCUUUAAUGCUGGAUCac-3'         (SEQ ID NO: 2905)
                     3'-AAUCAUACAAGAAAUUACGACCUAGUG-5'       (SEQ ID NO: 2381)

HIF-1α-3079  Target: 5'-TTAGTATGTTCTTTAATGCTGGATCAC-3'      (SEQ ID NO: 3429)

5'-GUAUGUUCUUUAAUGCUGGAUCAca-3'         (SEQ ID NO: 2906)
                     3'-AUCAUACAAGAAAUUACGACCUAGUGU-5'       (SEQ ID NO: 2382)

HIF-1α-3080  Target: 5'-TAGTATGTTCTTTAATGCTGGATCACA-3'      (SEQ ID NO: 3430)

5'-CAGACAGCUCAUUUCUCAGUUUtt-3'          (SEQ ID NO: 2907)
                     3'-GUGUCUGUCGAGUAAAAGAGUCAAAAA-5'       (SEQ ID NO: 2383)

HIF-1α-3103  Target: 5'-CACAGACAGCTCATTTCTCAGTTTTT-3'       (SEQ ID NO: 3431)

5'-CAUUUCUCAGUUUUUGGUAUUta-3'           (SEQ ID NO: 2908)
                     3'-GAGUAAAAGAGUCAAAAACCAUAAAU-5'        (SEQ ID NO: 2384)

HIF-1α-3112  Target: 5'-CTCATTTTCTCAGTTTTTTGGTATTTA-3'      (SEQ ID NO: 3432)

5'-AUUUUCUCAGUUUUUUGGUAUUUaa-3'         (SEQ ID NO: 2909)
                     3'-AGUAAAAGAGUCAAAAAACCAUAAAUU-5'       (SEQ ID NO: 2385)
```

TABLE 2-continued

Selected Anti-HIF-1α DsiRNA Agents (Asymmetrics, HIF-1α)

```
HIF-1α-3113  Target: 5'-TCATTTTCTCAGTTTTTTGGTATTTAA-3'     (SEQ ID NO: 3433)

5'-UUUUCUCAGUUUUUUGGUAUUUAaa-3'       (SEQ ID NO: 2910)
                     3'-GUAAAAGAGUCAAAAAACCAUAAAUUU-5'     (SEQ ID NO: 2386)

HIF-1α-3114  Target: 5'-CATTTTCTCAGTTTTTTGGTATTTAAA-3'     (SEQ ID NO: 3434)

5'-UUUUUGGUAUUUAAACCAUUGCAtt-3'       (SEQ ID NO: 2911)
                     3'-CAAAAAACCAUAAAUUUGGUAACGUAA-5'     (SEQ ID NO: 2387)

HIF-1α-3124  Target: 5'-GTTTTTTGGTATTTAAACCATTGCATT-3'     (SEQ ID NO: 3435)

5'-UGGUAUUUAAACCAUUGCAUUGCag-3'       (SEQ ID NO: 2912)
                     3'-AAACCAUAAAUUUGGUAACGUAACGUC-5'     (SEQ ID NO: 2388)

HIF-1α-3128  Target: 5'-TTTGGTATTTAAACCATTGCATTGCAG-3'     (SEQ ID NO: 3436)

5'-GGUAUUUAAACCAUUGCAUUGCAgt-3'       (SEQ ID NO: 2913)
                     3'-AACCAUAAAUUUGGUAACGUAACGUCA-5'     (SEQ ID NO: 2389)

HIF-1α-3129  Target: 5'-TTGGTATTTAAACCATTGCATTGCAGT-3'     (SEQ ID NO: 3437)

5'-UUAAACCAUUGCAUUGCAGUAGCat-3'       (SEQ ID NO: 2914)
                     3'-UAAAUUUGGUAACGUAACGUCAUCGUA-5'     (SEQ ID NO: 2390)

HIF-1α-3134  Target: 5'-ATTTAAACCATTGCATTGCAGTAGCAT-3'     (SEQ ID NO: 3438)

5'-AUUGCAGUAGCAUCAUUUUAAAAaa-3'       (SEQ ID NO: 2915)
                     3'-CGUAACGUCAUCGUAGUAAAAUUUUUU-5'     (SEQ ID NO: 2391)

HIF-1α-3146  Target: 5'-GCATTGCAGTAGCATCATTTTAAAAAA-3'     (SEQ ID NO: 3439)

5'-AGUAGCAUCAUUUUAAAAAAUGCac-3'       (SEQ ID NO: 2916)
                     3'-CGUCAUCGUAGUAAAAUUUUUUACGUG-5'     (SEQ ID NO: 2392)

HIF-1α-3151  Target: 5'-GCAGTAGCATCATTTTAAAAAATGCAC-3'     (SEQ ID NO: 3440)

5'-GUAGCAUCAUUUUAAAAAAUGCAcc-3'       (SEQ ID NO: 2917)
                     3'-GUCAUCGUAGUAAAAUUUUUUACGUGG-5'     (SEQ ID NO: 2393)

HIF-1α-3152  Target: 5'-CAGTAGCATCATTTTAAAAAATGCACC-3'     (SEQ ID NO: 3441)

5'-CAUUUUAAAAAAUGCACCUUUUUat-3'       (SEQ ID NO: 2918)
                     3'-UAGUAAAAUUUUUUACGUGGAAAAAUA-5'     (SEQ ID NO: 2394)

HIF-1α-3159  Target: 5'-ATCATTTTAAAAAATGCACCTTTTTAT-3'     (SEQ ID NO: 3442)

5'-AUUUUAAAAAAUGCACCUUUUUAtt-3'       (SEQ ID NO: 2919)
                     3'-AGUAAAAUUUUUUACGUGGAAAAAUAA-5'     (SEQ ID NO: 2395)

HIF-1α-3160  Target: 5'-TCATTTTAAAAAATGCACCTTTTTATT-3'     (SEQ ID NO: 3443)

5'-UUUUAAAAAAUGCACCUUUUUAUtt-3'       (SEQ ID NO: 2920)
                     3'-GUAAAAUUUUUUACGUGGAAAAAUAAA-5'     (SEQ ID NO: 2396)

HIF-1α-3161  Target: 5'-CATTTTAAAAAATGCACCTTTTTATTT-3'     (SEQ ID NO: 3444)

5'-UUUAAAAAAUGCACCUUUUUAUUta-3'       (SEQ ID NO: 2921)
                     3'-UAAAAUUUUUUACGUGGAAAAAUAAAU-5'     (SEQ ID NO: 2397)

HIF-1α-3162  Target: 5'-ATTTTAAAAAATGCACCTTTTTATTTA-3'     (SEQ ID NO: 3445)

5'-UUAAAAAAUGCACCUUUUUAUUUat-3'       (SEQ ID NO: 2922)
                     3'-AAAAUUUUUUACGUGGAAAAAUAAAUA-5'     (SEQ ID NO: 2398)

HIF-1α-3163  Target: 5'-TTTTAAAAAATGCACCTTTTTATTTAT-3'     (SEQ ID NO: 3446)

5'-UAAAAAAUGCACCUUUUUAUUUAtt-3'       (SEQ ID NO: 2923)
                     3'-AAAUUUUUUACGUGGAAAAAUAAAUAA-5'     (SEQ ID NO: 2399)

HIF-1α-3164  Target: 5'-TTTAAAAAATGCACCTTTTTATTTATT-3'     (SEQ ID NO: 3447)

5'-AAAAAAUGCACCUUUUUAUUUAUUta-3'      (SEQ ID NO: 2924)
                     3'-AUUUUUUACGUGGAAAAAUAAAUAAAU-5'     (SEQ ID NO: 2400)
```

TABLE 2-continued

Selected Anti-HIF-1α DsiRNA Agents (Asymmetrics, HIF-1α)

```
HIF-1α-3166  Target: 5'-TAAAAAATGCACCTTTTTATTTATTTA-3'      (SEQ ID NO: 3448)

5'-AAAUGCACCUUUUUAUUUAUUUAtt-3'        (SEQ ID NO: 2925)
                     3'-UUUUUACGUGGAAAAAUAAAUAAAUAA-5'      (SEQ ID NO: 2401)

HIF-1α-3168  Target: 5'-AAAAATGCACCTTTTTATTTATTTATT-3'      (SEQ ID NO: 3449)

5'-CUUUUUAUUUAUUUAUUUUUGGCta-3'        (SEQ ID NO: 2926)
                     3'-UGGAAAAAUAAAUAAAUAAAAACCGAU-5'      (SEQ ID NO: 2402)

HIF-1α-3176  Target: 5'-ACCTTTTTATTTATTTATTTTTGGCTA-3'      (SEQ ID NO: 3450)

5'-AUUUAUUUAUUUUUGGCUAGGGAgt-3'        (SEQ ID NO: 2927)
                     3'-AAUAAAUAAAUAAAAACCGAUCCCUCA-5'      (SEQ ID NO: 2403)

HIF-1α-3182  Target: 5'-TTATTTATTTATTTTTGGCTAGGGAGT-3'      (SEQ ID NO: 3451)

5'-UUAUUUAUUUUUGGCUAGGGAGUtt-3'        (SEQ ID NO: 2928)
                     3'-UAAAUAAAUAAAAACCGAUCCCUCAAA-5'      (SEQ ID NO: 2404)

HIF-1α-3184  Target: 5'-ATTTATTTATTTTTGGCTAGGGAGTTT-3'      (SEQ ID NO: 3452)

5'-UAUUUAUUUUUGGCUAGGGAGUUta-3'        (SEQ ID NO: 2929)
                     3'-AAAUAAAUAAAAACCGAUCCCUCAAAU-5'      (SEQ ID NO: 2405)

HIF-1α-3185  Target: 5'-TTTATTTATTTTTGGCTAGGGAGTTTA-3'      (SEQ ID NO: 3453)

5'-AUUUAUUUUUGGCUAGGGAGUUUat-3'        (SEQ ID NO: 2930)
                     3'-AAUAAAUAAAAACCGAUCCCUCAAAUA-5'      (SEQ ID NO: 2406)

HIF-1α-3186  Target: 5'-TTATTTATTTTTGGCTAGGGAGTTTAT-3'      (SEQ ID NO: 3454)

5'-UUUAUUUUUGGCUAGGGAGUUUAtc-3'        (SEQ ID NO: 2931)
                     3'-AUAAAUAAAAACCGAUCCCUCAAAUAG-5'      (SEQ ID NO: 2407)

HIF-1α-3187  Target: 5'-TATTTATTTTTGGCTAGGGAGTTTATC-3'      (SEQ ID NO: 3455)

5'-GGAGUUUAUCCCUUUUUCGAAUUat-3'        (SEQ ID NO: 2932)
                     3'-UCCCUCAAAUAGGGAAAAGCUUAAUA-5'       (SEQ ID NO: 2408)

HIF-1α-3202  Target: 5'-AGGGAGTTTATCCCTTTTTCGAATTAT-3'      (SEQ ID NO: 3456)

5'-GAGUUUAUCCCUUUUUCGAAUUAtt-3'        (SEQ ID NO: 2933)
                     3'-CCCUCAAAUAGGGAAAAGCUUAAUAA-5'       (SEQ ID NO: 2409)

HIF-1α-3203  Target: 5'-GGGAGTTTATCCCTTTTTCGAATTATT-3'      (SEQ ID NO: 3457)

5'-AGUUUAUCCCUUUUUCGAAUUAUtt-3'        (SEQ ID NO: 2934)
                     3'-CCUCAAAUAGGGAAAAGCUUAAUAAA-5'       (SEQ ID NO: 2410)

HIF-1α-3204  Target: 5'-GGAGTTTATCCCTTTTTCGAATTATTT-3'      (SEQ ID NO: 3458)

5'-GUUUAUCCCUUUUUCGAAUUAUUtt-3'        (SEQ ID NO: 2935)
                     3'-CUCAAAUAGGGAAAAGCUUAAUAAAA-5'       (SEQ ID NO: 2411)

HIF-1α-3205  Target: 5'-GAGTTTATCCCTTTTTCGAATTATTTT-3'      (SEQ ID NO: 3459)

5'-UUUAUCCCUUUUUCGAAUUAUUUtt-3'        (SEQ ID NO: 2936)
                     3'-UCAAAUAGGGAAAAGCUUAAUAAAAA-5'       (SEQ ID NO: 2412)

HIF-1α-3206  Target: 5'-AGTTTATCCCTTTTTCGAATTATTTTT-3'      (SEQ ID NO: 3460)

5'-UUAUCCCUUUUUCGAAUUAUUUUta-3'        (SEQ ID NO: 2937)
                     3'-CAAAUAGGGAAAAGCUUAAUAAAAAU-5'       (SEQ ID NO: 2413)

HIF-1α-3207  Target: 5'-GTTTATCCCTTTTTCGAATTATTTTTA-3'      (SEQ ID NO: 3461)

5'-CGAAUUAUUUUUAAGAAGAUGCCaa-3'        (SEQ ID NO: 2938)
                     3'-AAGCUUAAUAAAAAUUCUUCUACGGUU-5'      (SEQ ID NO: 2414)

HIF-1α-3219  Target: 5'-TTCGAATTATTTTTAAGAAGATGCCAA-3'      (SEQ ID NO: 3462)

5'-UAUUUUUAAGAAGAUGCCAAUAUaa-3'        (SEQ ID NO: 2939)
                     3'-UAAUAAAAAUUCUUCUACGGUUAUAUU-5'      (SEQ ID NO: 2415)
```

TABLE 2-continued

Selected Anti-HIF-1α DsiRNA Agents (Asymmetrics, HIF-1α)

```
HIF-1α-3224 Target: 5'-ATTATTTTTAAGAAGATGCCAATATAA-3'    (SEQ ID NO: 3463)

5'-AUUUUUAAGAAGAUGCCAAUAUAat-3'      (SEQ ID NO: 2940)
                    3'-AAUAAAAAUUCUUCUACGGUUAUAUUA-5'    (SEQ ID NO: 2416)

HIF-1α-3225 Target: 5'-TTATTTTTAAGAAGATGCCAATATAAT-3'    (SEQ ID NO: 3464)

5'-UUUUAAGAAGAUGCCAAUAUAAUtt-3'     (SEQ ID NO: 2941)
                    3'-UAAAAAUUCUUCUACGGUUAUAUUAAA-5'    (SEQ ID NO: 2417)

HIF-1α-3227 Target: 5'-ATTTTTAAGAAGATGCCAATATAATTT-3'    (SEQ ID NO: 3465)

5'-UUUAAGAAGAUGCCAAUAUAAUUtt-3'     (SEQ ID NO: 2942)
                    3'-AAAAAUUCUUCUACGGUUAUAUUAAAA-5'    (SEQ ID NO: 2418)

HIF-1α-3228 Target: 5'-TTTTTAAGAAGATGCCAATATAATTTT-3'    (SEQ ID NO: 3466)

5'-UAAGAAGAUGCCAAUAUAAUUUUtg-3'     (SEQ ID NO: 2943)
                    3'-AAAUUCUUCUACGGUUAUAUUAAAAAC-5'    (SEQ ID NO: 2419)

HIF-1α-3230 Target: 5'-TTTAAGAAGATGCCAATATAATTTTTG-3'    (SEQ ID NO: 3467)

5'-AAGAAGAUGCCAAUAUAAUUUUUgt-3'     (SEQ ID NO: 2944)
                    3'-AAUUCUUCUACGGUUAUAUUAAAAACA-5'    (SEQ ID NO: 2420)

HIF-1α-3231 Target: 5'-TTAAGAAGATGCCAATATAATTTTTGT-3'    (SEQ ID NO: 3468)

5'-GAAGAUGCCAAUAUAAUUUUUGUaa-3'     (SEQ ID NO: 2945)
                    3'-UUCUUCUACGGUUAUAUUAAAAACAUU-5'    (SEQ ID NO: 2421)

HIF-1α-3233 Target: 5'-AAGAAGATGCCAATATAATTTTTGTAA-3'    (SEQ ID NO: 3469)

5'-AAGAUGCCAAUAUAAUUUUUGUAag-3'     (SEQ ID NO: 2946)
                    3'-UCUUCUACGGUUAUAUUAAAAACAUUC-5'    (SEQ ID NO: 2422)

HIF-1α-3234 Target: 5'-AGAAGATGCCAATATAATTTTTGTAAG-3'    (SEQ ID NO: 3470)

5'-AGAUGCCAAUAUAAUUUUUGUAAga-3'     (SEQ ID NO: 2947)
                    3'-CUUCUACGGUUAUAUUAAAAACAUUCU-5'    (SEQ ID NO: 2423)

HIF-1α-3235 Target: 5'-GAAGATGCCAATATAATTTTTGTAAGA-3'    (SEQ ID NO: 3471)

5'-AAUAUAAUUUUUGUAAGAAGGCAgt-3'     (SEQ ID NO: 2948)
                    3'-GGUUAUAUUAAAAACAUUCUUCCGUCA-5'    (SEQ ID NO: 2424)

HIF-1α-3242 Target: 5'-CCAATATAATTTTTGTAAGAAGGCAGT-3'    (SEQ ID NO: 3472)

5'-UAAUUUUUGUAAGAAGGCAGUAAcc-3'     (SEQ ID NO: 2949)
                    3'-AUAUUAAAAACAUUCUUCCGUCAUUGG-5'    (SEQ ID NO: 2425)

HIF-1α-3246 Target: 5'-TATAATTTTTGTAAGAAGGCAGTAACC-3'    (SEQ ID NO: 3473)

5'-AUUUUUGUAAGAAGGCAGUAACCtt-3'     (SEQ ID NO: 2950)
                    3'-AUUAAAAACAUUCUUCCGUCAUUGGAA-5'    (SEQ ID NO: 2426)

HIF-1α-3248 Target: 5'-TAATTTTTGTAAGAAGGCAGTAACCTT-3'    (SEQ ID NO: 3474)

5'-CAUGAUCAUAGGCAGUUGAAAAAtt-3'     (SEQ ID NO: 2951)
                    3'-UAGUACUAGUAUCCGUCAACUUUUUAA-5'    (SEQ ID NO: 2427)

HIF-1α-3277 Target: 5'-ATCATGATCATAGGCAGTTGAAAAATT-3'    (SEQ ID NO: 3475)

5'-UGAUCAUAGGCAGUUGAAAAAUUtt-3'     (SEQ ID NO: 2952)
                    3'-GUACUAGUAUCCGUCAACUUUUUAAAA-5'    (SEQ ID NO: 2428)

HIF-1α-3279 Target: 5'-CATGATCATAGGCAGTTGAAAAATTTT-3'    (SEQ ID NO: 3476)

5'-CAUAGGCAGUUGAAAAAUUUUUAca-3'     (SEQ ID NO: 2953)
                    3'-UAGUAUCCGUCAACUUUUUAAAAAUGU-5'    (SEQ ID NO: 2429)

HIF-1α-3283 Target: 5'-ATCATAGGCAGTTGAAAAATTTTTACA-3'    (SEQ ID NO: 3477)

5'-UAGGCAGUUGAAAAAUUUUUACAcc-3'     (SEQ ID NO: 2954)
                    3'-GUAUCCGUCAACUUUUUAAAAAUGUGG-5'    (SEQ ID NO: 2430)
```

TABLE 2-continued

Selected Anti-HIF-1α DsiRNA Agents (Asymmetrics, HIF-1α)

```
HIF-1α-3285 Target: 5'-CATAGGCAGTTGAAAAATTTTTACACC-3'   (SEQ ID NO: 3478)

5'-UGAAAAAUUUUUACACCUUUUUUUtt-3'    (SEQ ID NO: 2955)
                    3'-CAACUUUUUAAAAAUGUGGAAAAAAAA-5'   (SEQ ID NO: 2431)

HIF-1α-3293 Target: 5'-GTTGAAAAATTTTTACACCTTTTTTTT-3'   (SEQ ID NO: 3479)

5'-GAAAAAUUUUUACACCUUUUUUUtc-3'     (SEQ ID NO: 2956)
                    3'-AACUUUUUAAAAAUGUGGAAAAAAAAG-5'   (SEQ ID NO: 2432)

HIF-1α-3294 Target: 5'-TTGAAAAATTTTTACACCTTTTTTTTC-3'   (SEQ ID NO: 3480)

5'-AAAAAUUUUUACACCUUUUUUUUca-3'     (SEQ ID NO: 2957)
                    3'-ACUUUUUAAAAAUGUGGAAAAAAAAGU-5'   (SEQ ID NO: 2433)

HIF-1α-3295 Target: 5'-TGAAAAATTTTTACACCTTTTTTTCA-3'    (SEQ ID NO: 3481)

5'-AAAAUUUUUACACCUUUUUUUUCac-3'     (SEQ ID NO: 2958)
                    3'-CUUUUUAAAAAUGUGGAAAAAAAAGUG-5'   (SEQ ID NO: 2434)

HIF-1α-3296 Target: 5'-GAAAAATTTTTACACCTTTTTTTCAC-3'    (SEQ ID NO: 3482)

5'-AAAUUUUUACACCUUUUUUUUCAca-3'     (SEQ ID NO: 2959)
                    3'-UUUUUAAAAAUGUGGAAAAAAAAGUGU-5'   (SEQ ID NO: 2435)

HIF-1α-3297 Target: 5'-AAAAATTTTTACACCTTTTTTTCACA-3'    (SEQ ID NO: 3483)

5'-UUUUUUUCACAUUUUACAUAAAUaa-3'     (SEQ ID NO: 2960)
                    3'-GAAAAAAAGUGUAAAAUGUAUUUAUU-5'    (SEQ ID NO: 2436)

HIF-1α-3311 Target: 5'-CTTTTTTTTCACATTTTACATAAATAA-3'   (SEQ ID NO: 3484)

5'-UUUUUUCACAUUUUACAUAAAUAat-3'     (SEQ ID NO: 2961)
                    3'-AAAAAAAAGUGUAAAAUGUAUUUAUUA-5'   (SEQ ID NO: 2437)

HIF-1α-3312 Target: 5'-TTTTTTTTCACATTTTACATAAATAAT-3'   (SEQ ID NO: 3485)

5'-UUUUUCACAUUUUACAUAAAUAAta-3'     (SEQ ID NO: 2962)
                    3'-AAAAAAAGUGUAAAAUGUAUUUAUUAU-5'   (SEQ ID NO: 2438)

HIF-1α-3313 Target: 5'-TTTTTTTCACATTTTACATAAATAATA-3'   (SEQ ID NO: 3486)

5'-UUUUCACAUUUUACAUAAAUAAUaa-3'     (SEQ ID NO: 2963)
                    3'-AAAAAAGUGUAAAAUGUAUUUAUUAUU-5'   (SEQ ID NO: 2439)

HIF-1α-3314 Target: 5'-TTTTTTCACATTTTACATAAATAATAA-3'   (SEQ ID NO: 3487)

5'-CAUUUUACAUAAAUAAUAAUGCUtt-3'     (SEQ ID NO: 2964)
                    3'-GUGUAAAAUGUAUUUAUUAUUACGAAA-5'   (SEQ ID NO: 2440)

HIF-1α-3320 Target: 5'-CACATTTTACATAAATAATAATGCTTT-3'   (SEQ ID NO: 3488)

5'-GUAGCCACAAUUGCACAAUAUAUtt-3'     (SEQ ID NO: 2965)
                    3'-ACCAUCGGUGUUAACGUGUUAUAUAAA-5'   (SEQ ID NO: 2441)

HIF-1α-3359 Target: 5'-TGGTAGCCACAATTGCACAATATATTT-3'   (SEQ ID NO: 3489)

5'-AAUAUAUUUUCUUAAAAAAUACCag-3'     (SEQ ID NO: 2966)
                    3'-UGUUAUAUAAAAGAAUUUUUUAUGGUC-5'   (SEQ ID NO: 2442)

HIF-1α-3375 Target: 5'-ACAATATATTTTCTTAAAAAATACCAG-3'   (SEQ ID NO: 3490)

5'-CUUAAAAAAUACCAGCAGUUACUca-3'     (SEQ ID NO: 2967)
                    3'-AAGAAUUUUUUAUGGUCGUCAAUGAGU-5'   (SEQ ID NO: 2443)

HIF-1α-3385 Target: 5'-TTCTTAAAAAATACCAGCAGTTACTCA-3'   (SEQ ID NO: 3491)

5'-CAGUUACUCAUGGAAUAUAUUCUgc-3'     (SEQ ID NO: 2968)
                    3'-UCGUCAAUGAGUACCUUAUAUAAGACG-5'   (SEQ ID NO: 2444)

HIF-1α-3400 Target: 5'-AGCAGTTACTCATGGAATATATTCTGC-3'   (SEQ ID NO: 3492)

5'-CAUGGAAUAUAUUCUGCGUUUAUaa-3'     (SEQ ID NO: 2969)
                    3'-GAGUACCUUAUAUAAGACGCAAAUAUU-5'   (SEQ ID NO: 2445)
```

TABLE 2-continued

Selected Anti-HIF-1α DsiRNA Agents (Asymmetrics, HIF-1α)

```
HIF-1α-3408  Target: 5'-CTCATGGAATATATTCTGCGTTTATAA-3'      (SEQ ID NO: 3493)

5'-AUGGAAUAUAUUCUGCGUUUAUAaa-3'        (SEQ ID NO: 2970)
                     3'-AGUACCUUAUAUAAGACGCAAAUAUUU-5'      (SEQ ID NO: 2446)

HIF-1α-3409  Target: 5'-TCATGGAATATATTCTGCGTTTATAAA-3'      (SEQ ID NO: 3494)

5'-UGGAAUAUAUUCUGCGUUUAUAAaa-3'        (SEQ ID NO: 2971)
                     3'-GUACCUUAUAUAAGACGCAAAUAUUUU-5'      (SEQ ID NO: 2447)

HIF-1α-3410  Target: 5'-CATGGAATATATTCTGCGTTTATAAAA-3'      (SEQ ID NO: 3495)

5'-GGAAUAUAUUCUGCGUUUAUAAAac-3'        (SEQ ID NO: 2972)
                     3'-UACCUUAUAUAAGACGCAAAUAUUUUG-5'      (SEQ ID NO: 2448)

HIF-1α-3411  Target: 5'-ATGGAATATATTCTGCGTTTATAAAAC-3'      (SEQ ID NO: 3496)

5'-GAAUAUAUUCUGCGUUUAUAAAAct-3'        (SEQ ID NO: 2973)
                     3'-ACCUUAUAUAAGACGCAAAUAUUUUGA-5'      (SEQ ID NO: 2449)

HIF-1α-3412  Target: 5'-TGGAATATATTCTGCGTTTATAAAACT-3'      (SEQ ID NO: 3497)

5'-AAUAUAUUCUGCGUUUAUAAAACta-3'        (SEQ ID NO: 2974)
                     3'-CCUUAUAUAAGACGCAAAUAUUUUGAU-5'      (SEQ ID NO: 2450)

HIF-1α-3413  Target: 5'-GGAATATATTCTGCGTTTATAAAACTA-3'      (SEQ ID NO: 3498)

5'-AUAUAUUCUGCGUUUAUAAAACUag-3'        (SEQ ID NO: 2975)
                     3'-CUUAUAUAAGACGCAAAUAUUUUGAUC-5'      (SEQ ID NO: 2451)

HIF-1α-3414  Target: 5'-GAATATATTCTGCGTTTATAAAACTAG-3'      (SEQ ID NO: 3499)

5'-AUAAAACUAGUUUUUAAGAAGAAat-3'        (SEQ ID NO: 2976)
                     3'-AAUAUUUUGAUCAAAAAUUCUUCUUUA-5'      (SEQ ID NO: 2452)

HIF-1α-3429  Target: 5'-TTATAAAACTAGTTTTTAAGAAGAAAT-3'      (SEQ ID NO: 3500)

5'-CUAGUUUUUAAGAAGAAAUUUUUtt-3'        (SEQ ID NO: 2977)
                     3'-UUGAUCAAAAAUUCUUCUUUAAAAAAA-5'      (SEQ ID NO: 2453)

HIF-1α-3435  Target: 5'-AACTAGTTTTTAAGAAGAAATTTTTTT-3'      (SEQ ID NO: 3501)

5'-UAGUUUUUAAGAAGAAAUUUUUUtt-3'        (SEQ ID NO: 2978)
                     3'-UGAUCAAAAAUUCUUCUUUAAAAAAAA-5'      (SEQ ID NO: 2454)

HIF-1α-3436  Target: 5'-ACTAGTTTTTAAGAAGAAATTTTTTTT-3'     (SEQ ID NO: 3502)

5'-AGUUUUUAAGAAGAAAUUUUUUUtg-3'        (SEQ ID NO: 2979)
                     3'-GAUCAAAAAUUCUUCUUUAAAAAAAAC-5'      (SEQ ID NO: 2455)

HIF-1α-3437  Target: 5'-CTAGTTTTTAAGAAGAAATTTTTTTTG-3'      (SEQ ID NO: 3503)

5'-GUUUUUAAGAAGAAAUUUUUUUUgg-3'        (SEQ ID NO: 2980)
                     3'-AUCAAAAAUUCUUCUUUAAAAAAAACC-5'      (SEQ ID NO: 2456)

HIF-1α-3438  Target: 5'-TAGTTTTTAAGAAGAAATTTTTTTTGG-3'      (SEQ ID NO: 3504)

5'-UUUAAGAAGAAAUUUUUUUUGGCct-3'        (SEQ ID NO: 2981)
                     3'-AAAAAUUCUUCUUUAAAAAAAACCGGA-5'      (SEQ ID NO: 2457)

HIF-1α-3441  Target: 5'-TTTTTAAGAAGAAATTTTTTTTGGCCT-3'      (SEQ ID NO: 3505)

5'-AAGAAAUUUUUUUUGGCCUAUGAaa-3'        (SEQ ID NO: 2982)
                     3'-UCUUCUUUAAAAAAAACCGGAUACUUU-5'      (SEQ ID NO: 2458)

HIF-1α-3447  Target: 5'-AGAAGAAATTTTTTTTGGCCTATGAAA-3'      (SEQ ID NO: 3506)

5'-GAAAUUUUUUUUGGCCUAUGAAtt-3'         (SEQ ID NO: 2983)
                     3'-UUCUUUAAAAAAAACCGGAUACUUUAA-5'      (SEQ ID NO: 2459)

HIF-1α-3449  Target: 5'-AAGAAATTTTTTTTGGCCTATGAAATT-3'      (SEQ ID NO: 3507)

5'-AAUUUUUUUUGGCCUAUGAAAUUgt-3'        (SEQ ID NO: 2984)
                     3'-CUUUAAAAAAAACCGGAUACUUUAACA-5'      (SEQ ID NO: 2460)
```

TABLE 2-continued

Selected Anti-HIF-1α DsiRNA Agents (Asymmetrics, HIF-1α)

```
HIF-1α-3451  Target: 5'-GAAATTTTTTTGGCCTATGAAATTGT-3'       (SEQ ID NO: 3508)

5'-UUUUUUUUGGCCUAUGAAAUUGUta-3'       (SEQ ID NO: 2985)
                     3'-UUAAAAAAAACCGGAUACUUUAACAAU-5'     (SEQ ID NO: 2461)

HIF-1α-3453  Target: 5'-AATTTTTTTGGCCTATGAAATTGTTA-3'      (SEQ ID NO: 3509)

5'-UUUUUGGCCUAUGAAAUUGUUAAac-3'       (SEQ ID NO: 2986)
                     3'-AAAAAAACCGGAUACUUUAACAAUUUG-5'     (SEQ ID NO: 2462)

HIF-1α-3456  Target: 5'-TTTTTTTGGCCTATGAAATTGTTAAAC-3'     (SEQ ID NO: 3510)

5'-UUUUGGCCUAUGAAAUUGUUAAAcc-3'       (SEQ ID NO: 2987)
                     3'-AAAAAACCGGAUACUUUAACAAUUUGG-5'     (SEQ ID NO: 2463)

HIF-1α-3457  Target: 5'-TTTTTTGGCCTATGAAATTGTTAAACC-3'     (SEQ ID NO: 3511)

5'-UUUGGCCUAUGAAAUUGUUAAACct-3'       (SEQ ID NO: 2988)
                     3'-AAAAACCGGAUACUUUAACAAUUUGGA-5'     (SEQ ID NO: 2464)

HIF-1α-3458  Target: 5'-TTTTTGGCCTATGAAATTGTTAAACCT-3'     (SEQ ID NO: 3512)

5'-UUGGCCUAUGAAAUUGUUAAACCtg-3'       (SEQ ID NO: 2989)
                     3'-AAAACCGGAUACUUUAACAAUUUGGAC-5'     (SEQ ID NO: 2465)

HIF-1α-3459  Target: 5'-TTTTGGCCTATGAAATTGTTAAACCTG-3'     (SEQ ID NO: 3513)

5'-CUAUGAAAUUGUUAAACCUGGAAca-3'       (SEQ ID NO: 2990)
                     3'-CGGAUACUUUAACAAUUUGGACCUUGU-5'     (SEQ ID NO: 2466)

HIF-1α-3464  Target: 5'-GCCTATGAAATTGTTAAACCTGGAACA-3'     (SEQ ID NO: 3514)

5'-AUGAAAUUGUUAAACCUGGAACAtg-3'       (SEQ ID NO: 2991)
                     3'-GAUACUUUAACAAUUUGGACCUUGUAC-5'     (SEQ ID NO: 2467)

HIF-1α-3466  Target: 5'-CTATGAAATTGTTAAACCTGGAACATG-3'     (SEQ ID NO: 3515)

5'-AAUUGUUAAACCUGGAACAUGACat-3'       (SEQ ID NO: 2992)
                     3'-CUUUAACAAUUUGGACCUUGUACUGUA-5'     (SEQ ID NO: 2468)

HIF-1α-3470  Target: 5'-GAAATTGTTAAACCTGGAACATGACAT-3'     (SEQ ID NO: 3516)

5'-AUUGUUAAACCUGGAACAUGACAtt-3'       (SEQ ID NO: 2993)
                     3'-UUUAACAAUUUGGACCUUGUACUGUAA-5'     (SEQ ID NO: 2469)

HIF-1α-3471  Target: 5'-AAATTGTTAAACCTGGAACATGACATT-3'     (SEQ ID NO: 3517)

5'-CUGGAACAUGACAUUGUUAAUCAta-3'       (SEQ ID NO: 2994)
                     3'-UGGACCUUGUACUGUAACAAUUAGUAU-5'     (SEQ ID NO: 2470)

HIF-1α-3481  Target: 5'-ACCTGGAACATGACATTGTTAATCATA-3'     (SEQ ID NO: 3518)

5'-CAUGACAUUGUUAAUCAUAUAAUaa-3'       (SEQ ID NO: 2995)
                     3'-UUGUACUGUAACAAUUAGUAUAUUAUU-5'     (SEQ ID NO: 2471)

HIF-1α-3487  Target: 5'-AACATGACATTGTTAATCATATAATAA-3'     (SEQ ID NO: 3519)

5'-AUGACAUUGUUAAUCAUAUAAUAat-3'       (SEQ ID NO: 2996)
                     3'-UGUACUGUAACAAUUAGUAUAUUAUUA-5'     (SEQ ID NO: 2472)

HIF-1α-3488  Target: 5'-ACATGACATTGTTAATCATATAATAAT-3'     (SEQ ID NO: 3520)

5'-CAUUGUUAAUCAUAUAAUAAUGAtt-3'       (SEQ ID NO: 2997)
                     3'-CUGUAACAAUUAGUAUAUUAUUACUAA-5'     (SEQ ID NO: 2473)

HIF-1α-3492  Target: 5'-GACATTGTTAATCATATAATAATGATT-3'     (SEQ ID NO: 3521)

5'-UUGUUAAUCAUAUAAUAAUGAUUct-3'       (SEQ ID NO: 2998)
                     3'-GUAACAAUUAGUAUAUUAUUACUAAGA-5'     (SEQ ID NO: 2474)

HIF-1α-3494  Target: 5'-CATTGTTAATCATATAATAATGATTCT-3'     (SEQ ID NO: 3522)

5'-UGUUAAUCAUAUAAUAAUGAUUCtt-3'       (SEQ ID NO: 2999)
                     3'-UAACAAUUAGUAUAUUAUUACUAAGAA-5'     (SEQ ID NO: 2475)
```

TABLE 2-continued

Selected Anti-HIF-1α DsiRNA Agents (Asymmetrics, HIF-1α)

```
HIF-1α-3495  Target: 5'-ATTGTTAATCATATAATAATGATTCTT-3'      (SEQ ID NO: 3523)

5'-GUUAAUCAUAUAAUAAUGAUUCUta-3'        (SEQ ID NO: 3000)
                     3'-AACAAUUAGUAUAUUAUUACUAAGAAU-5'      (SEQ ID NO: 2476)

HIF-1α-3496  Target: 5'-TTGTTAATCATATAATAATGATTCTTA-3'      (SEQ ID NO: 3524)

5'-AUAUAAUAAUGAUUCUUAAAUGCtg-3'        (SEQ ID NO: 3001)
                     3'-AGUAUAUUAUUACUAAGAAUUUACGAC-5'      (SEQ ID NO: 2477)

HIF-1α-3503  Target: 5'-TCATATAATAATGATTCTTAAATGCTG-3'      (SEQ ID NO: 3525)

5'-UAUAAUAAUGAUUCUUAAAUGCUgt-3'        (SEQ ID NO: 3002)
                     3'-GUAUAUUAUUACUAAGAAUUUACGACA-5'      (SEQ ID NO: 2478)

HIF-1α-3504  Target: 5'-CATATAATAATGATTCTTAAATGCTGT-3'      (SEQ ID NO: 3526)

5'-AUAAUGAUUCUUAAAUGCUGUAUgg-3'        (SEQ ID NO: 3003)
                     3'-AUUAUUACUAAGAAUUUACGACAUACC-5'      (SEQ ID NO: 2479)

HIF-1α-3508  Target: 5'-TAATAATGATTCTTAAATGCTGTATGG-3'      (SEQ ID NO: 3527)

5'-AUGAUUCUUAAAUGCUGUAUGGUtt-3'        (SEQ ID NO: 3004)
                     3'-AUUACUAAGAAUUUACGACAUACCAAA-5'      (SEQ ID NO: 2480)

HIF-1α-3511  Target: 5'-TAATGATTCTTAAATGCTGTATGGTTT-3'      (SEQ ID NO: 3528)

5'-UGAUUCUUAAAUGCUGUAUGGUUta-3'        (SEQ ID NO: 3005)
                     3'-UUACUAAGAAUUUACGACAUACCAAAU-5'      (SEQ ID NO: 2481)

HIF-1α-3512  Target: 5'-AATGATTCTTAAATGCTGTATGGTTTA-3'      (SEQ ID NO: 3529)

5'-GAUUCUUAAAUGCUGUAUGGUUUat-3'        (SEQ ID NO: 3006)
                     3'-UACUAAGAAUUUACGACAUACCAAAUA-5'      (SEQ ID NO: 2482)

HIF-1α-3513  Target: 5'-ATGATTCTTAAATGCTGTATGGTTTAT-3'      (SEQ ID NO: 3530)

5'-UUAAAUGCUGUAUGGUUUAUUAUtt-3'        (SEQ ID NO: 3007)
                     3'-AGAAUUUACGACAUACCAAAUAAUAAA-5'      (SEQ ID NO: 2483)

HIF-1α-3518  Target: 5'-TCTTAAATGCTGTATGGTTTATTATTT-3'      (SEQ ID NO: 3531)

5'-UAAAUGCUGUAUGGUUUAUUAUUta-3'        (SEQ ID NO: 3008)
                     3'-GAAUUUACGACAUACCAAAUAAUAAAU-5'      (SEQ ID NO: 2484)

HIF-1α-3519  Target: 5'-CTTAAATGCTGTATGGTTTATTATTTA-3'      (SEQ ID NO: 3532)

5'-AAUGCUGUAUGGUUUAUUAUUUAaa-3'        (SEQ ID NO: 3009)
                     3'-AUUUACGACAUACCAAAUAAUAAAUUU-5'      (SEQ ID NO: 2485)

HIF-1α-3521  Target: 5'-TAAATGCTGTATGGTTTATTATTTAAA-3'      (SEQ ID NO: 3533)

5'-UAUGGUUUAUUAUUUAAAUGGGUaa-3'        (SEQ ID NO: 3010)
                     3'-ACAUACCAAAUAAUAAAUUUACCCAUU-5'      (SEQ ID NO: 2486)

HIF-1α-3528  Target: 5'-TGTATGGTTTATTATTTAAATGGGTAA-3'      (SEQ ID NO: 3534)

5'-UGGUUUAUUAUUUAAAUGGGUAAag-3'        (SEQ ID NO: 3011)
                     3'-AUACCAAAUAAUAAAUUUACCCAUUUC-5'      (SEQ ID NO: 2487)

HIF-1α-3530  Target: 5'-TATGGTTTATTATTTAAATGGGTAAAG-3'      (SEQ ID NO: 3535)

5'-GGUUUAUUAUUUAAAUGGGUAAAgc-3'        (SEQ ID NO: 3012)
                     3'-UACCAAAUAAUAAAUUUACCCAUUUCG-5'      (SEQ ID NO: 2488)

HIF-1α-3531  Target: 5'-ATGGTTTATTATTTAAATGGGTAAAGC-3'      (SEQ ID NO: 3536)

5'-UUUAUUAUUUAAAUGGGUAAAGCca-3'        (SEQ ID NO: 3013)
                     3'-CCAAAUAAUAAAUUUACCCAUUUCGGU-5'      (SEQ ID NO: 2489)

HIF-1α-3533  Target: 5'-GGTTTATTATTTAAATGGGTAAAGCCA-3'      (SEQ ID NO: 3537)

5'-UUAUUAUUUAAAUGGGUAAAGCCat-3'        (SEQ ID NO: 3014)
                     3'-CAAAUAAUAAAUUUACCCAUUUCGGUA-5'      (SEQ ID NO: 2490)
```

TABLE 2-continued

Selected Anti-HIF-1α DsiRNA Agents (Asymmetrics, HIF-1α)

```
HIF-1α-3534  Target: 5'-GTTTATTATTTAAATGGGTAAAGCCAT-3'      (SEQ ID NO: 3538)

5'-AUUUAAAUGGGUAAAGCCAUUUAca-3'        (SEQ ID NO: 3015)
                     3'-AAUAAAUUUACCCAUUUCGGUAAAUGU-5'      (SEQ ID NO: 2491)

HIF-1α-3539  Target: 5'-TTATTTAAATGGGTAAAGCCATTTACA-3'      (SEQ ID NO: 3539)

5'-AUGGGUAAAGCCAUUUACAUAAUat-3'        (SEQ ID NO: 3016)
                     3'-UUUACCCAUUUCGGUAAAUGUAUUAUA-5'      (SEQ ID NO: 2492)

HIF-1α-3545  Target: 5'-AAATGGGTAAAGCCATTTACATAATAT-3'      (SEQ ID NO: 3540)

5'-GGUAAAGCCAUUUACAUAAUAUAga-3'        (SEQ ID NO: 3017)
                     3'-ACCCAUUUCGGUAAAUGUAUUAUAUCU-5'      (SEQ ID NO: 2493)

HIF-1α-3548  Target: 5'-TGGGTAAAGCCATTTACATAATATAGA-3'      (SEQ ID NO: 3541)

5'-UAAAGCCAUUUACAUAAUAUAGAaa-3'        (SEQ ID NO: 3018)
                     3'-CCAUUUCGGUAAAUGUAUUAUAUCUUU-5'      (SEQ ID NO: 2494)

HIF-1α-3550  Target: 5'-GGTAAAGCCATTTACATAATATAGAAA-3'      (SEQ ID NO: 3542)

5'-AAAGCCAUUUACAUAAUAUAGAAag-3'        (SEQ ID NO: 3019)
                     3'-CAUUUCGGUAAAUGUAUUAUAUCUUUC-5'      (SEQ ID NO: 2495)

HIF-1α-3551  Target: 5'-GTAAAGCCATTTACATAATATAGAAAG-3'      (SEQ ID NO: 3543)

5'-CAUUUACAUAAUAUAGAAAGAUAtg-3'        (SEQ ID NO: 3020)
                     3'-CGGUAAAUGUAUUAUAUCUUUCUAUAC-5'      (SEQ ID NO: 2496)

HIF-1α-3556  Target: 5'-GCCATTTACATAATATAGAAAGATATG-3'      (SEQ ID NO: 3544)

5'-AAUAUAGAAAGAUAUGCAUAUAUct-3'        (SEQ ID NO: 3021)
                     3'-UAUUAUAUCUUUCUAUACGUAUAUAGA-5'      (SEQ ID NO: 2497)

HIF-1α-3565  Target: 5'-ATAATATAGAAAGATATGCATATATCT-3'      (SEQ ID NO: 3545)

5'-AUAUAGAAAGAUAUGCAUAUAUCta-3'        (SEQ ID NO: 3022)
                     3'-AUUAUAUCUUUCUAUACGUAUAUAGAU-5'      (SEQ ID NO: 2498)

HIF-1α-3566  Target: 5'-TAATATAGAAAGATATGCATATATCTA-3'      (SEQ ID NO: 3546)

5'-UAUAGAAAGAUAUGCAUAUAUCUag-3'        (SEQ ID NO: 3023)
                     3'-UUAUAUCUUUCUAUACGUAUAUAGAUC-5'      (SEQ ID NO: 2499)

HIF-1α-3567  Target: 5'-AATATAGAAAGATATGCATATATCTAG-3'      (SEQ ID NO: 3547)

5'-GAAAGAUAUGCAUAUAUCUAGAAgg-3'        (SEQ ID NO: 3024)
                     3'-AUCUUUCUAUACGUAUAUAGAUCUUCC-5'      (SEQ ID NO: 2500)

HIF-1α-3571  Target: 5'-TAGAAAGATATGCATATATCTAGAAGG-3'      (SEQ ID NO: 3548)

5'-AGAUAUGCAUAUAUCUAGAAGGUat-3'        (SEQ ID NO: 3025)
                     3'-UUUCUAUACGUAUAUAGAUCUUCCAUA-5'      (SEQ ID NO: 2501)

HIF-1α-3574  Target: 5'-AAAGATATGCATATATCTAGAAGGTAT-3'      (SEQ ID NO: 3549)

5'-GAUAUGCAUAUAUCUAGAAGGUAtg-3'        (SEQ ID NO: 3026)
                     3'-UUCUAUACGUAUAUAGAUCUUCCAUAC-5'      (SEQ ID NO: 2502)

HIF-1α-3575  Target: 5'-AAGATATGCATATATCTAGAAGGTATG-3'      (SEQ ID NO: 3550)

5'-AUAUGCAUAUAUCUAGAAGGUAUgt-3'        (SEQ ID NO: 3027)
                     3'-UCUAUACGUAUAUAGAUCUUCCAUACA-5'      (SEQ ID NO: 2503)

HIF-1α-3576  Target: 5'-AGATATGCATATATCTAGAAGGTATGT-3'      (SEQ ID NO: 3551)

5'-CAUAUAUCUAGAAGGUAUGUGGCat-3'        (SEQ ID NO: 3028)
                     3'-ACGUAUAUAGAUCUUCCAUACACCGUA-5'      (SEQ ID NO: 2504)

HIF-1α-3581  Target: 5'-TGCATATATCTAGAAGGTATGTGGCAT-3'      (SEQ ID NO: 3552)

5'-AUAUAUCUAGAAGGUAUGUGGCAtt-3'        (SEQ ID NO: 3029)
                     3'-CGUAUAUAGAUCUUCCAUACACCGUAA-5'      (SEQ ID NO: 2505)
```

TABLE 2-continued

Selected Anti-HIF-1α DsiRNA Agents (Asymmetrics, HIF-1α)

```
HIF-1α-3582  Target: 5'-GCATATATCTAGAAGGTATGTGGCATT-3'    (SEQ ID NO: 3553)

5'-UAGAAGGUAUGUGGCAUUUAUUUgg-3'      (SEQ ID NO: 3030)
                     3'-AGAUCUUCCAUACACCGUAAAUAAACC-5'    (SEQ ID NO: 2506)

HIF-1α-3589  Target: 5'-TCTAGAAGGTATGTGGCATTTATTTGG-3'    (SEQ ID NO: 3554)

5'-AGGUAUGUGGCAUUUAUUUGGAUaa-3'      (SEQ ID NO: 3031)
                     3'-CUUCCAUACACCGUAAAUAAACCUAUU-5'    (SEQ ID NO: 2507)

HIF-1α-3593  Target: 5'-GAAGGTATGTGGCATTTATTTGGATAA-3'    (SEQ ID NO: 3555)

5'-AUGUGGCAUUUAUUUGGAUAAAAtt-3'      (SEQ ID NO: 3032)
                     3'-CAUACACCGUAAAUAAACCUAUUUUAA-5'    (SEQ ID NO: 2508)

HIF-1α-3597  Target: 5'-GTATGTGGCATTTATTTGGATAAAATT-3'    (SEQ ID NO: 3556)

5'-GUGGCAUUUAUUUGGAUAAAAUUct-3'      (SEQ ID NO: 3033)
                     3'-UACACCGUAAAUAAACCUAUUUUAAGA-5'    (SEQ ID NO: 2509)

HIF-1α-3599  Target: 5'-ATGTGGCATTTATTTGGATAAAATTCT-3'    (SEQ ID NO: 3557)

5'-UAUUUGGAUAAAAUUCUCAAUUCag-3'      (SEQ ID NO: 3034)
                     3'-AAAUAAACCUAUUUUAAGAGUUAAGUC-5'    (SEQ ID NO: 2510)

HIF-1α-3607  Target: 5'-TTTATTTGGATAAAATTCTCAATTCAG-3'    (SEQ ID NO: 3558)

5'-GAUAAAAUUCUCAAUUCAGAGAAat-3'      (SEQ ID NO: 3035)
                     3'-ACCUAUUUUAAGAGUUAAGUCUCUUUA-5'    (SEQ ID NO: 2511)

HIF-1α-3613  Target: 5'-TGGATAAAATTCTCAATTCAGAGAAAT-3'    (SEQ ID NO: 3559)

5'-UAAAAUUCUCAAUUCAGAGAAAUca-3'      (SEQ ID NO: 3036)
                     3'-CUAUUUUAAGAGUUAAGUCUCUUUAGU-5'    (SEQ ID NO: 2512)

HIF-1α-3615  Target: 5'-GATAAAATTCTCAATTCAGAGAAATCA-3'    (SEQ ID NO: 3560)

5'-AAAUUCUCAAUUCAGAGAAAUCAtc-3'      (SEQ ID NO: 3037)
                     3'-AUUUUAAGAGUUAAGUCUCUUUAGUAG-5'    (SEQ ID NO: 2513)

HIF-1α-3617  Target: 5'-TAAAATTCTCAATTCAGAGAAATCATC-3'    (SEQ ID NO: 3561)

5'-AAUUCAGAGAAAUCAUCUGAUGUtt-3'      (SEQ ID NO: 3038)
                     3'-AGUUAAGUCUCUUUAGUAGACUACAAA-5'    (SEQ ID NO: 2514)

HIF-1α-3625  Target: 5'-TCAATTCAGAGAAATCATCTGATGTTT-3'    (SEQ ID NO: 3562)

5'-CAGAGAAAUCAUCUGAUGUUUCUat-3'      (SEQ ID NO: 3039)
                     3'-AAGUCUCUUUAGUAGACUACAAAGAUA-5'    (SEQ ID NO: 2515)

HIF-1α-3629  Target: 5'-TTCAGAGAAATCATCTGATGTTTCTAT-3'    (SEQ ID NO: 3563)

5'-AAAUCAUCUGAUGUUUCUAUAGUca-3'      (SEQ ID NO: 3040)
                     3'-UCUUUAGUAGACUACAAAGAUAUCAGU-5'    (SEQ ID NO: 2516)

HIF-1α-3634  Target: 5'-AGAAATCATCTGATGTTTCTATAGTCA-3'    (SEQ ID NO: 3564)

5'-UGAUGUUUCUAUAGUCACUUUGCca-3'      (SEQ ID NO: 3041)
                     3'-AGACUACAAAGAUAUCAGUGAAACGGU-5'    (SEQ ID NO: 2517)

HIF-1α-3642  Target: 5'-TCTGATGTTTCTATAGTCACTTTGCCA-3'    (SEQ ID NO: 3565)

5'-GAUGUUUCUAUAGUCACUUUGCCag-3'      (SEQ ID NO: 3042)
                     3'-GACUACAAAGAUAUCAGUGAAACGGUC-5'    (SEQ ID NO: 2518)

HIF-1α-3643  Target: 5'-CTGATGTTTCTATAGTCACTTTGCCAG-3'    (SEQ ID NO: 3566)

5'-AAAAGAAAACAAUACCCUAUGUAgt-3'      (SEQ ID NO: 3043)
                     3'-AGUUUCUUUUGUUAUGGGAUACAUCA-5'     (SEQ ID NO: 2519)

HIF-1α-3671  Target: 5'-TCAAAAGAAAACAATACCCTATGTAGT-3'    (SEQ ID NO: 3567)

5'-AAGAAAACAAUACCCUAUGUAGUtg-3'      (SEQ ID NO: 3044)
                     3'-UUUUCUUUUGUUAUGGGAUACAUCAAC-5'    (SEQ ID NO: 2520)
```

TABLE 2-continued

Selected Anti-HIF-1α DsiRNA Agents (Asymmetrics, HIF-1α)

```
HIF-1α-3673 Target: 5'-AAAAGAAAACAATACCCTATGTAGTTG-3'     (SEQ ID NO: 3568)

5'-AGAAAACAAUACCCUAUGUAGUUgt-3'      (SEQ ID NO: 3045)
                    3'-UUUCUUUUGUUAUGGGAUACAUCAACA-5'    (SEQ ID NO: 2521)

HIF-1α-3674 Target: 5'-AAAGAAAACAATACCCTATGTAGTTGT-3'    (SEQ ID NO: 3569)

5'-AAAACAAUACCCUAUGUAGUUGUgg-3'      (SEQ ID NO: 3046)
                    3'-UCUUUUGUUAUGGGAUACAUCAACACC-5'    (SEQ ID NO: 2522)

HIF-1α-3676 Target: 5'-AGAAAACAATACCCTATGTAGTTGTGG-3'    (SEQ ID NO: 3570)

5'-CAAUACCCUAUGUAGUUGUGGAAgt-3'      (SEQ ID NO: 3047)
                    3'-UUGUUAUGGGAUACAUCAACACCUUCA-5'    (SEQ ID NO: 2523)

HIF-1α-3680 Target: 5'-AACAATACCCTATGTAGTTGTGGAAGT-3'    (SEQ ID NO: 3571)

5'-UAUGUAGUUGUGGAAGUUUAUGCta-3'      (SEQ ID NO: 3048)
                    3'-GGAUACAUCAACACCUUCAAAUACGAU-5'    (SEQ ID NO: 2524)

HIF-1α-3688 Target: 5'-CCTATGTAGTTGTGGAAGTTTATGCTA-3'    (SEQ ID NO: 3572)

5'-AUGUAGUUGUGGAAGUUUAUGCUaa-3'      (SEQ ID NO: 3049)
                    3'-GAUACAUCAACACCUUCAAAUACGAUU-5'    (SEQ ID NO: 2525)

HIF-1α-3689 Target: 5'-CTATGTAGTTGTGGAAGTTTATGCTAA-3'    (SEQ ID NO: 3573)

5'-GUUGUGGAAGUUUAUGCUAAUAUg-3'       (SEQ ID NO: 3050)
                    3'-AUCAACACCUUCAAAUACGAUUAUAAC-5'    (SEQ ID NO: 2526)

HIF-1α-3694 Target: 5'-TAGTTGTGGAAGTTTATGCTAATATTG-3'    (SEQ ID NO: 3574)

5'-UUGUGGAAGUUUAUGCUAAUAUUgt-3'      (SEQ ID NO: 3051)
                    3'-UCAACACCUUCAAAUACGAUUAUAACA-5'    (SEQ ID NO: 2527)

HIF-1α-3695 Target: 5'-AGTTGTGGAAGTTTATGCTAATATTGT-3'    (SEQ ID NO: 3575)

5'-GUGGAAGUUUAUGCUAAUAUUGUgt-3'      (SEQ ID NO: 3052)
                    3'-AACACCUUCAAAUACGAUUAUAACACA-5'    (SEQ ID NO: 2528)

HIF-1α-3697 Target: 5'-TTGTGGAAGTTTATGCTAATATTGTGT-3'    (SEQ ID NO: 3576)

5'-GGAAGUUUAUGCUAAUAUUGUGUaa-3'      (SEQ ID NO: 3053)
                    3'-CACCUUCAAAUACGAUUAUAACACAUU-5'    (SEQ ID NO: 2529)

HIF-1α-3699 Target: 5'-GTGGAAGTTTATGCTAATATTGTGTAA-3'    (SEQ ID NO: 3577)

5'-GAAGUUUAUGCUAAUAUUGUGUAac-3'      (SEQ ID NO: 3054)
                    3'-ACCUUCAAAUACGAUUAUAACACAUUG-5'    (SEQ ID NO: 2530)

HIF-1α-3700 Target: 5'-TGGAAGTTTATGCTAATATTGTGTAAC-3'    (SEQ ID NO: 3578)

5'-AAGUUUAUGCUAAUAUUGUGUAAct-3'      (SEQ ID NO: 3055)
                    3'-CCUUCAAAUACGAUUAUAACACAUUGA-5'    (SEQ ID NO: 2531)

HIF-1α-3701 Target: 5'-GGAAGTTTATGCTAATATTGTGTAACT-3'    (SEQ ID NO: 3579)

5'-GUUUAUGCUAAUAUUGUGUAACUga-3'      (SEQ ID NO: 3056)
                    3'-UUCAAAUACGAUUAUAACACAUUGACU-5'    (SEQ ID NO: 2532)

HIF-1α-3703 Target: 5'-AAGTTTATGCTAATATTGTGTAACTGA-3'    (SEQ ID NO: 3580)

5'-CUAAUAUUGUGUAACUGAUAUUAaa-3'      (SEQ ID NO: 3057)
                    3'-ACGAUUAUAACACAUUGACUAUAAUUU-5'    (SEQ ID NO: 2533)

HIF-1α-3710 Target: 5'-TGCTAATATTGTGTAACTGATATTAAA-3'    (SEQ ID NO: 3581)

5'-AAUAUUGUGUAACUGAUAUUAAAcc-3'      (SEQ ID NO: 3058)
                    3'-GAUUAUAACACAUUGACUAUAAUUUGG-5'    (SEQ ID NO: 2534)

HIF-1α-3712 Target: 5'-CTAATATTGTGTAACTGATATTAAACC-3'    (SEQ ID NO: 3582)

5'-UAUUGUGUAACUGAUAUUAAACCta-3'      (SEQ ID NO: 3059)
                    3'-UUAUAACACAUUGACUAUAAUUUGGAU-5'    (SEQ ID NO: 2535)
```

TABLE 2-continued

Selected Anti-HIF-1α DsiRNA Agents (Asymmetrics, HIF-1α)

```
HIF-1α-3714 Target: 5'-AATATTGTGTAACTGATATTAAACCTA-3'  (SEQ ID NO: 3583)

5'-CUGAUAUUAAACCUAAAUGUUCUgc-3'   (SEQ ID NO: 3060)
                    3'-UUGACUAUAAUUUGGAUUUACAAGACG-5' (SEQ ID NO: 2536)

HIF-1α-3724 Target: 5'-AACTGATATTAAACCTAAATGTTCTGC-3'  (SEQ ID NO: 3584)

5'-GUUGGUAUAAAGAUAUUUUGAGCag-3'   (SEQ ID NO: 3061)
                    3'-GACAACCAUAUUUCUAUAAAACUCGUC-5' (SEQ ID NO: 2537)

HIF-1α-3756 Target: 5'-CTGTTGGTATAAAGATATTTTGAGCAG-3'  (SEQ ID NO: 3585)

5'-UAUAAAGAUAUUUUGAGCAGACUgt-3'   (SEQ ID NO: 3062)
                    3'-CCAUAUUUCUAUAAAACUCGUCUGACA-5' (SEQ ID NO: 2538)

HIF-1α-3761 Target: 5'-GGTATAAAGATATTTTGAGCAGACTGT-3'  (SEQ ID NO: 3586)

5'-AAGAUAUUUUGAGCAGACUGUAAac-3'   (SEQ ID NO: 3063)
                    3'-AUUUCUAUAAAACUCGUCUGACAUUUG-5' (SEQ ID NO: 2539)

HIF-1α-3765 Target: 5'-TAAAGATATTTTGAGCAGACTGTAAAC-3'  (SEQ ID NO: 3587)

5'-AGAUAUUUUGAGCAGACUGUAAAca-3'   (SEQ ID NO: 3064)
                    3'-UUUCUAUAAAACUCGUCUGACAUUUGU-5' (SEQ ID NO: 2540)

HIF-1α-3766 Target: 5'-AAAGATATTTTGAGCAGACTGTAAACA-3'  (SEQ ID NO: 3588)

5'-GAUAUUUUGAGCAGACUGUAAACaa-3'   (SEQ ID NO: 3065)
                    3'-UUCUAUAAAACUCGUCUGACAUUUGUU-5' (SEQ ID NO: 2541)

HIF-1α-3767 Target: 5'-AAGATATTTTGAGCAGACTGTAAACAA-3'  (SEQ ID NO: 3589)

5'-UUUGAGCAGACUGUAAACAAGAAaa-3'   (SEQ ID NO: 3066)
                    3'-UAAACUCGUCUGACAUUUGUUCUUUU-5'  (SEQ ID NO: 2542)

HIF-1α-3772 Target: 5'-ATTTTGAGCAGACTGTAAACAAGAAAA-3'  (SEQ ID NO: 3590)

5'-UGAGCAGACUGUAAACAAGAAAAaa-3'   (SEQ ID NO: 3067)
                    3'-AAACUCGUCUGACAUUUGUUCUUUUUU-5' (SEQ ID NO: 2543)

HIF-1α-3774 Target: 5'-TTTGAGCAGACTGTAAACAAGAAAAAA-3'  (SEQ ID NO: 3591)

5'-CAGACUGUAAACAAGAAAAAAAAaa-3'   (SEQ ID NO: 3068)
                    3'-UCGUCUGACAUUUGUUCUUUUUUUUUU-5' (SEQ ID NO: 2544)

HIF-1α-3778 Target: 5'-AGCAGACTGTAAACAAGAAAAAAAAAA-3'  (SEQ ID NO: 3592)

5'-CUGUAAACAAGAAAAAAAAAAUCat-3'   (SEQ ID NO: 3069)
                    3'-CUGACAUUUGUUCUUUUUUUUUUAGUA-5' (SEQ ID NO: 2545)

HIF-1α-3782 Target: 5'-GACTGTAAACAAGAAAAAAAAAATCAT-3'  (SEQ ID NO: 3593)

5'-UGUAAACAAGAAAAAAAAAAUCAtg-3'   (SEQ ID NO: 3070)
                    3'-UGACAUUUGUUCUUUUUUUUUUAGUAC-5' (SEQ ID NO: 2546)

HIF-1α-3783 Target: 5'-ACTGTAAACAAGAAAAAAAAAATCATG-3'  (SEQ ID NO: 3594)

5'-AAAAAAAAUCAUGCAUUCUUAGCaa-3'   (SEQ ID NO: 3071)
                    3'-UUUUUUUUUUAGUACGUAAGAAUCGUU-5' (SEQ ID NO: 2547)

HIF-1α-3795 Target: 5'-AAAAAAAAATCATGCATTCTTAGCAA-3'   (SEQ ID NO: 3595)

5'-AAAAAAAUCAUGCAUUCUUAGCaa-3'    (SEQ ID NO: 3072)
                    3'-UUUUUUUUUAGUACGUAAGAAUCGUUU-5' (SEQ ID NO: 2548)

HIF-1α-3796 Target: 5'-AAAAAAAAATCATGCATTCTTAGCAAA-3'  (SEQ ID NO: 3596)

5'-CAUGCAUUCUUAGCAAAAUUGCCta-3'   (SEQ ID NO: 3073)
                    3'-UAGUACGUAAGAAUCGUUUUAACGGAU-5' (SEQ ID NO: 2549)

HIF-1α-3804 Target: 5'-ATCATGCATTCTTAGCAAAATTGCCTA-3'  (SEQ ID NO: 3597)

5'-CUUAGCAAAAUUGCCUAGUAUGUta-3'   (SEQ ID NO: 3074)
                    3'-AAGAAUCGUUUUAACGGAUCAUACAAU-5' (SEQ ID NO: 2550)
```

TABLE 2-continued

Selected Anti-HIF-1α DsiRNA Agents (Asymmetrics, HIF-1α)

```
HIF-1α-3812 Target: 5'-TTCTTAGCAAAATTGCCTAGTATGTTA-3'       (SEQ ID NO: 3598)

5'-UUAGCAAAAUUGCCUAGUAUGUUaa-3'         (SEQ ID NO: 3075)
                    3'-AGAAUCGUUUUAACGGAUCAUACAAUU-5'       (SEQ ID NO: 2551)

HIF-1α-3813 Target: 5'-TCTTAGCAAAATTGCCTAGTATGTTAA-3'       (SEQ ID NO: 3599)

5'-AAAAUUGCCUAGUAUGUUAAUUUgc-3'         (SEQ ID NO: 3076)
                    3'-CGUUUUAACGGAUCAUACAAUUAAACG-5'       (SEQ ID NO: 2552)

HIF-1α-3818 Target: 5'-GCAAAATTGCCTAGTATGTTAATTTGC-3'       (SEQ ID NO: 3600)

5'-AAUUGCCUAGUAUGUUAAUUUGCtc-3'         (SEQ ID NO: 3077)
                    3'-UUUUAACGGAUCAUACAAUUAAACGAG-5'       (SEQ ID NO: 2553)

HIF-1α-3820 Target: 5'-AAAATTGCCTAGTATGTTAATTTGCTC-3'       (SEQ ID NO: 3601)

5'-AUUGCCUAGUAUGUUAAUUUGCUca-3'         (SEQ ID NO: 3078)
                    3'-UUUAACGGAUCAUACAAUUAAACGAGU-5'       (SEQ ID NO: 2554)

HIF-1α-3821 Target: 5'-AAATTGCCTAGTATGTTAATTTGCTCA-3'       (SEQ ID NO: 3602)

5'-UAGUAUGUUAAUUUGCUCAAAAUac-3'         (SEQ ID NO: 3079)
                    3'-GGAUCAUACAAUUAAACGAGUUUUAUG-5'       (SEQ ID NO: 2555)

HIF-1α-3827 Target: 5'-CCTAGTATGTTAATTTGCTCAAAATAC-3'       (SEQ ID NO: 3603)

5'-AGUAUGUUAAUUUGCUCAAAAUAca-3'         (SEQ ID NO: 3080)
                    3'-GAUCAUACAAUUAAACGAGUUUUAUGU-5'       (SEQ ID NO: 2556)

HIF-1α-3828 Target: 5'-CTAGTATGTTAATTTGCTCAAAATACA-3'       (SEQ ID NO: 3604)

5'-GUAUGUUAAUUUGCUCAAAAUACaa-3'         (SEQ ID NO: 3081)
                    3'-AUCAUACAAUUAAACGAGUUUUAUGUU-5'       (SEQ ID NO: 2557)

HIF-1α-3829 Target: 5'-TAGTATGTTAATTTGCTCAAAATACAA-3'       (SEQ ID NO: 3605)

5'-UAAUUUGCUCAAAAUACAAUGUUtg-3'         (SEQ ID NO: 3082)
                    3'-CAAUUAAACGAGUUUUAUGUUACAAAC-5'       (SEQ ID NO: 2558)

HIF-1α-3835 Target: 5'-GTTAATTTGCTCAAAATACAATGTTTG-3'       (SEQ ID NO: 3606)

5'-AAUUUGCUCAAAAUACAAUGUUUga-3'         (SEQ ID NO: 3083)
                    3'-AAUUAAACGAGUUUUAUGUUACAAACU-5'       (SEQ ID NO: 2559)

HIF-1α-3836 Target: 5'-TTAATTTGCTCAAAATACAATGTTTGA-3'       (SEQ ID NO: 3607)

5'-UUUGCUCAAAAUACAAUGUUUGAtt-3'         (SEQ ID NO: 3084)
                    3'-UUAAACGAGUUUUAUGUUACAAACUAA-5'       (SEQ ID NO: 2560)

HIF-1α-3838 Target: 5'-AATTTGCTCAAAATACAATGTTTGATT-3'       (SEQ ID NO: 3608)

5'-CAAAAUACAAUGUUUGAUUUUAUgc-3'         (SEQ ID NO: 3085)
                    3'-GAGUUUUAUGUUACAAACUAAAAUACG-5'       (SEQ ID NO: 2561)

HIF-1α-3844 Target: 5'-CTCAAAATACAATGTTTGATTTTATGC-3'       (SEQ ID NO: 3609)

5'-AAAUACAAUGUUUGAUUUUAUGCac-3'         (SEQ ID NO: 3086)
                    3'-GUUUUAUGUUACAAACUAAAAUACGUG-5'       (SEQ ID NO: 2562)

HIF-1α-3846 Target: 5'-CAAAATACAATGTTTGATTTTATGCAC-3'       (SEQ ID NO: 3610)

5'-AAUACAAUGUUUGAUUUUAUGCAct-3'         (SEQ ID NO: 3087)
                    3'-UUUUAUGUUACAAACUAAAAUACGUGA-5'       (SEQ ID NO: 2563)

HIF-1α-3847 Target: 5'-AAAATACAATGTTTGATTTTATGCACT-3'       (SEQ ID NO: 3611)

5'-AUGUUUGAUUUUAUGCACUUUGUcg-3'         (SEQ ID NO: 3088)
                    3'-GUUACAAACUAAAAUACGUGAAACAGC-5'       (SEQ ID NO: 2564)

HIF-1α-3853 Target: 5'-CAATGTTTGATTTTATGCACTTTGTCG-3'       (SEQ ID NO: 3612)

5'-UGUUUGAUUUUAUGCACUUUGUCgc-3'         (SEQ ID NO: 3089)
                    3'-UUACAAACUAAAAUACGUGAAACAGCG-5'       (SEQ ID NO: 2565)
```

TABLE 2-continued

Selected Anti-HIF-1α DsiRNA Agents (Asymmetrics, HIF-1α)

```
HIF-1α-3854 Target:  5'-AATGTTTGATTTTATGCACTTTGTCGC-3'       (SEQ ID NO: 3613)

5'-UAUGCACUUUGUCGCUAUUAACAtc-3'         (SEQ ID NO: 3090)
                     3'-AAAUACGUGAAACAGCGAUAAUUGUAG-5'       (SEQ ID NO: 2566)

HIF-1α-3864 Target:  5'-TTTATGCACTTTGTCGCTATTAACATC-3'       (SEQ ID NO: 3614)

5'-UUGUCGCUAUUAACAUCCUUUUUtt-3'         (SEQ ID NO: 3091)
                     3'-GAAACAGCGAUAAUUGUAGGAAAAAAA-5'       (SEQ ID NO: 2567)

HIF-1α-3872 Target:  5'-CTTTGTCGCTATTAACATCCTTTTTTT-3'       (SEQ ID NO: 3615)

5'-UUUUUUCAUGUAGAUUUCAAUAAtt-3'         (SEQ ID NO: 3092)
                     3'-GAAAAAAGUACAUCUAAAGUUAUUAA-5'        (SEQ ID NO: 2568)

HIF-1α-3891 Target:  5'-CTTTTTTTCATGTAGATTTCAATAATT-3'       (SEQ ID NO: 3616)

5'-UUUUUCAUGUAGAUUUCAAUAAUtg-3'         (SEQ ID NO: 3093)
                     3'-AAAAAAAGUACAUCUAAAGUUAUUAAC-5'       (SEQ ID NO: 2569)

HIF-1α-3892 Target:  5'-TTTTTTTCATGTAGATTTCAATAATTG-3'       (SEQ ID NO: 3617)

5'-CAUGUAGAUUUCAAUAAUUGAGUaa-3'         (SEQ ID NO: 3094)
                     3'-AAGUACAUCUAAAGUUAUUAACUCAUU-5'       (SEQ ID NO: 2570)

HIF-1α-3897 Target:  5'-TTCATGTAGATTTCAATAATTGAGTAA-3'       (SEQ ID NO: 3618)

5'-AUGUAGAUUUCAAUAAUUGAGUAat-3'         (SEQ ID NO: 3095)
                     3'-AGUACAUCUAAAGUUAUUAACUCAUUA-5'       (SEQ ID NO: 2571)

HIF-1α-3898 Target:  5'-TCATGTAGATTTCAATAATTGAGTAAT-3'       (SEQ ID NO: 3619)

5'-UGUAGAUUUCAAUAAUUGAGUAAtt-3'         (SEQ ID NO: 3096)
                     3'-GUACAUCUAAAGUUAUUAACUCAUUAA-5'       (SEQ ID NO: 2572)

HIF-1α-3899 Target:  5'-CATGTAGATTTCAATAATTGAGTAATT-3'       (SEQ ID NO: 3620)

5'-GUAGAUUUCAAUAAUUGAGUAAUtt-3'         (SEQ ID NO: 3097)
                     3'-UACAUCUAAAGUUAUUAACUCAUUAAA-5'       (SEQ ID NO: 2573)

HIF-1α-3900 Target:  5'-ATGTAGATTTCAATAATTGAGTAATTT-3'       (SEQ ID NO: 3621)

5'-UAGAUUUCAAUAAUUGAGUAAUUtt-3'         (SEQ ID NO: 3098)
                     3'-ACAUCUAAAGUUAUUAACUCAUUAAAA-5'       (SEQ ID NO: 2574)

HIF-1α-3901 Target:  5'-TGTAGATTTCAATAATTGAGTAATTTT-3'       (SEQ ID NO: 3622)

5'-AGAUUUCAAUAAUUGAGUAAUUUta-3'         (SEQ ID NO: 3099)
                     3'-CAUCUAAAGUUAUUAACUCAUUAAAAU-5'       (SEQ ID NO: 2575)

HIF-1α-3902 Target:  5'-GTAGATTTCAATAATTGAGTAATTTTA-3'       (SEQ ID NO: 3623)

5'-GAUUUCAAUAAUUGAGUAAUUUUag-3'         (SEQ ID NO: 3100)
                     3'-AUCUAAAGUUAUUAACUCAUUAAAAUC-5'       (SEQ ID NO: 2576)

HIF-1α-3903 Target:  5'-TAGATTTCAATAATTGAGTAATTTTAG-3'       (SEQ ID NO: 3624)

5'-AUUUCAAUAAUUGAGUAAUUUUAga-3'         (SEQ ID NO: 3101)
                     3'-UCUAAAGUUAUUAACUCAUUAAAAUCU-5'       (SEQ ID NO: 2577)

HIF-1α-3904 Target:  5'-AGATTTCAATAATTGAGTAATTTTAGA-3'       (SEQ ID NO: 3625)

5'-AUAAUUGAGUAAUUUUAGAAGCAtt-3'         (SEQ ID NO: 3102)
                     3'-GUUAUUAACUCAUUAAAAUCUUCGUAA-5'       (SEQ ID NO: 2578)

HIF-1α-3910 Target:  5'-CAATAATTGAGTAATTTTAGAAGCATT-3'       (SEQ ID NO: 3626)

5'-UUGAGUAAUUUUAGAAGCAUUAUtt-3'         (SEQ ID NO: 3103)
                     3'-UUAACUCAUUAAAAUCUUCGUAAUAAA-5'       (SEQ ID NO: 2579)

HIF-1α-3914 Target:  5'-AATTGAGTAATTTTAGAAGCATTATTT-3'       (SEQ ID NO: 3627)

5'-UGAGUAAUUUUAGAAGCAUUAUUtt-3'         (SEQ ID NO: 3104)
                     3'-UAACUCAUUAAAAUCUUCGUAAUAAAA-5'       (SEQ ID NO: 2580)
```

TABLE 2-continued

Selected Anti-HIF-1α DsiRNA Agents (Asymmetrics, HIF-1α)

```
HIF-1α-3915 Target: 5'-ATTGAGTAATTTTAGAAGCATTATTTT-3'      (SEQ ID NO: 3628)

5'-AGUAAUUUUAGAAGCAUUAUUUUag-3'       (SEQ ID NO: 3105)
                    3'-ACUCAUUAAAAUCUUCGUAAUAAAAUC-5'     (SEQ ID NO: 2581)

HIF-1α-3917 Target: 5'-TGAGTAATTTTAGAAGCATTATTTTAG-3'     (SEQ ID NO: 3629)

5'-AUUUUAGAAGCAUUAUUUUAGGAat-3'       (SEQ ID NO: 3106)
                    3'-AUUAAAAUCUUCGUAAUAAAAUCCUUA-5'     (SEQ ID NO: 2582)

HIF-1α-3921 Target: 5'-TAATTTTAGAAGCATTATTTTAGGAAT-3'     (SEQ ID NO: 3630)

5'-UAGAAGCAUUAUUUUAGGAAUAUat-3'       (SEQ ID NO: 3107)
                    3'-AAAUCUUCGUAAUAAAAUCCUUAUAUA-5'     (SEQ ID NO: 2583)

HIF-1α-3925 Target: 5'-TTTAGAAGCATTATTTTAGGAATATAT-3'     (SEQ ID NO: 3631)

5'-GAAGCAUUAUUUUAGGAAUAUAUag-3'       (SEQ ID NO: 3108)
                    3'-AUCUUCGUAAUAAAAUCCUUAUAUAUC-5'     (SEQ ID NO: 2584)

HIF-1α-3927 Target: 5'-TAGAAGCATTATTTTAGGAATATATAG-3'     (SEQ ID NO: 3632)

5'-CAUUAUUUUAGGAAUAUAUAGUUgt-3'       (SEQ ID NO: 3109)
                    3'-UCGUAAUAAAAUCCUUAUAUAUCAACA-5'     (SEQ ID NO: 2585)

HIF-1α-3931 Target: 5'-AGCATTATTTTAGGAATATATAGTTGT-3'     (SEQ ID NO: 3633)

5'-UUAUUUUAGGAAUAUAUAGUUGUca-3'       (SEQ ID NO: 3110)
                    3'-GUAAUAAAAUCCUUAUAUAUCAACAGU-5'     (SEQ ID NO: 2586)

HIF-1α-3933 Target: 5'-CATTATTTTAGGAATATATAGTTGTCA-3'     (SEQ ID NO: 3634)

5'-GGAAUAUAUAGUUGUCACAGUAAat-3'       (SEQ ID NO: 3111)
                    3'-AUCCUUAUAUAUCAACAGUGUCAUUUA-5'     (SEQ ID NO: 2587)

HIF-1α-3941 Target: 5'-TAGGAATATATAGTTGTCACAGTAAAT-3'     (SEQ ID NO: 3635)

5'-GAAUAUAUAGUUGUCACAGUAAAta-3'       (SEQ ID NO: 3112)
                    3'-UCCUUAUAUAUCAACAGUGUCAUUUAU-5'     (SEQ ID NO: 2588)

HIF-1α-3942 Target: 5'-AGGAATATATAGTTGTCACAGTAAATA-3'     (SEQ ID NO: 3636)

5'-AAUAUAUAGUUGUCACAGUAAAUat-3'       (SEQ ID NO: 3113)
                    3'-CCUUAUAUAUCAACAGUGUCAUUUAUA-5'     (SEQ ID NO: 2589)

HIF-1α-3943 Target: 5'-GGAATATATAGTTGTCACAGTAAATAT-3'     (SEQ ID NO: 3637)

5'-UAUAUAGUUGUCACAGUAAAUAUct-3'       (SEQ ID NO: 3114)
                    3'-UUAUAUAUCAACAGUGUCAUUUAUAGA-5'     (SEQ ID NO: 2590)

HIF-1α-3945 Target: 5'-AATATATAGTTGTCACAGTAAATATCT-3'     (SEQ ID NO: 3638)

5'-AUAUAGUUGUCACAGUAAAUAUCtt-3'       (SEQ ID NO: 3115)
                    3'-UAUAUAUCAACAGUGUCAUUUAUAGAA-5'     (SEQ ID NO: 2591)

HIF-1α-3946 Target: 5'-ATATATAGTTGTCACAGTAAATATCTT-3'     (SEQ ID NO: 3639)

5'-GUUGUCACAGUAAAUAUCUUGUUtt-3'       (SEQ ID NO: 3116)
                    3'-AUCAACAGUGUCAUUUAUAGAACAAAA-5'     (SEQ ID NO: 2592)

HIF-1α-3951 Target: 5'-TAGTTGTCACAGTAAATATCTTGTTTT-3'     (SEQ ID NO: 3640)

5'-UUGUCACAGUAAAUAUCUUGUUUtt-3'       (SEQ ID NO: 3117)
                    3'-UCAACAGUGUCAUUUAUAGAACAAAAA-5'     (SEQ ID NO: 2593)

HIF-1α-3952 Target: 5'-AGTTGTCACAGTAAATATCTTGTTTTT-3'     (SEQ ID NO: 3641)

5'-AAAUAUCUUGUUUUUCUAUGUAca-3'        (SEQ ID NO: 3118)
                    3'-CAUUUAUAGAACAAAAAGAUACAUGU-5'      (SEQ ID NO: 2594)

HIF-1α-3962 Target: 5'-GTAAATATCTTGTTTTTTCTATGTACA-3'     (SEQ ID NO: 3642)

5'-AAUAUCUUGUUUUUUCUAUGUACat-3'       (SEQ ID NO: 3119)
                    3'-AUUUAUAGAACAAAAAGAUACAUGUA-5'      (SEQ ID NO: 2595)
```

TABLE 2-continued

Selected Anti-HIF-1α DsiRNA Agents (Asymmetrics, HIF-1α)

```
HIF-1α-3963   Target: 5'-TAAATATCTTGTTTTTCTATGTACAT-3'       (SEQ ID NO: 3643)

5'-CUUGUUUUUCUAUGUACAUUGUac-3'         (SEQ ID NO: 3120)
                      3'-UAGAACAAAAAAGAUACAUGUAACAUG-5'      (SEQ ID NO: 2596)

HIF-1α-3968   Target: 5'-ATCTTGTTTTTCTATGTACATTGTAC-3'       (SEQ ID NO: 3644)

5'-UUGUUUUUCUAUGUACAUUGUAca-3'         (SEQ ID NO: 3121)
                      3'-AGAACAAAAAAGAUACAUGUAACAUGU-5'      (SEQ ID NO: 2597)

HIF-1α-3969   Target: 5'-TCTTGTTTTTCTATGTACATTGTACA-3'       (SEQ ID NO: 3645)

5'-UGUUUUUCUAUGUACAUUGUACaa-3'         (SEQ ID NO: 3122)
                      3'-GAACAAAAAGAUACAUGUAACAUGUU-5'       (SEQ ID NO: 2598)

HIF-1α-3970   Target: 5'-CTTGTTTTTCTATGTACATTGTACAA-3'       (SEQ ID NO: 3646)

5'-GUUUUUCUAUGUACAUUGUACAaa-3'         (SEQ ID NO: 3123)
                      3'-AACAAAAAAGAUACAUGUAACAUGUUU-5'      (SEQ ID NO: 2599)

HIF-1α-3971   Target: 5'-TTGTTTTTCTATGTACATTGTACAAA-3'       (SEQ ID NO: 3647)

5'-CUAUGUACAUUGUACAAAUUUUUCa-3'        (SEQ ID NO: 3124)
                      3'-AAGAUACAUGUAACAUGUUUAAAAAGU-5'      (SEQ ID NO: 2600)

HIF-1α-3978   Target: 5'-TTCTATGTACATTGTACAAATTTTTCA-3'      (SEQ ID NO: 3648)

5'-UAUGUACAUUGUACAAAUUUUUCat-3'        (SEQ ID NO: 3125)
                      3'-AGAUACAUGUAACAUGUUUAAAAAGUA-5'      (SEQ ID NO: 2601)

HIF-1α-3979   Target: 5'-TCTATGTACATTGTACAAATTTTTCAT-3'      (SEQ ID NO: 3649)

5'-UUUUCAUUCCUUUUGCUCUUUGUgg-3'        (SEQ ID NO: 3126)
                      3'-UAAAAGUAAGGAAAACGAGAAACACC-5'       (SEQ ID NO: 2602)

HIF-1α-3997   Target: 5'-ATTTTTCATTCCTTTTGCTCTTTGTGG-3'      (SEQ ID NO: 3650)

5'-GUUGGAUCUAACACUAACUGUAUtg-3'        (SEQ ID NO: 3127)
                      3'-ACCAACCUAGAUUGUGAUUGACAUAAC-5'      (SEQ ID NO: 2603)

HIF-1α-4021   Target: 5'-TGGTTGGATCTAACACTAACTGTATTG-3'      (SEQ ID NO: 3651)

5'-UUGGAUCUAACACUAACUGUAUUgt-3'        (SEQ ID NO: 3128)
                      3'-CCAACCUAGAUUGUGAUUGACAUAACA-5'      (SEQ ID NO: 2604)

HIF-1α-4022   Target: 5'-GGTTGGATCTAACACTAACTGTATTGT-3'      (SEQ ID NO: 3652)

5'-GGAUCUAACACUAACUGUAUUGUtt-3'        (SEQ ID NO: 3129)
                      3'-AACCUAGAUUGUGAUUGACAUAACAAA-5'      (SEQ ID NO: 2605)

HIF-1α-4024   Target: 5'-TTGGATCTAACACTAACTGTATTGTTT-3'      (SEQ ID NO: 3653)

5'-GUAUUGUUUUGUUACAUCAAAUAaa-3'        (SEQ ID NO: 3130)
                      3'-GACAUAACAAAACAAUGUAGUUUAUUU-5'      (SEQ ID NO: 2606)

HIF-1α-4040   Target: 5'-CTGTATTGTTTTGTTACATCAAATAAA-3'      (SEQ ID NO: 3654)

5'-UAUUGUUUUGUUACAUCAAAUAAac-3'        (SEQ ID NO: 3131)
                      3'-ACAUAACAAAACAAUGUAGUUUAUUUG-5'      (SEQ ID NO: 2607)

HIF-1α-4041   Target: 5'-TGTATTGTTTTGTTACATCAAATAAAC-3'      (SEQ ID NO: 3655)

5'-AUUGUUUUGUUACAUCAAAUAAAca-3'        (SEQ ID NO: 3132)
                      3'-CAUAACAAAACAAUGUAGUUUAUUUGU-5'      (SEQ ID NO: 2608)

HIF-1α-4042   Target: 5'-GTATTGTTTTGTTACATCAAATAAACA-3'      (SEQ ID NO: 3656)

5'-UGUUUUGUUACAUCAAAUAAACAtc-3'        (SEQ ID NO: 3133)
                      3'-UAACAAAACAAUGUAGUUUAUUUGUAG-5'      (SEQ ID NO: 2609)

HIF-1α-4044   Target: 5'-ATTGTTTTGTTACATCAAATAAACATC-3'      (SEQ ID NO: 3657)

5'-UGUGGACCAGGCAAAAAAAAAAAaa-3'        (SEQ ID NO: 3134)
                      3'-AGACACCUGGUCCGUUUUUUUUUUUUU-5'      (SEQ ID NO: 2610)
```

TABLE 2-continued

Selected Anti-HIF-1α DsiRNA Agents (Asymmetrics, HIF-1α)

```
HIF-1α-4072 Target: 5'-TCTGTGGACCAGGCAAAAAAAAAAAAA-3'     (SEQ ID NO: 3658)

5'-GUGGACCAGGCAAAAAAAAAAAAaa-3'       (SEQ ID NO: 3135)
                    3'-GACACCUGGUCCGUUUUUUUUUUUUU-5'      (SEQ ID NO: 2611)

HIF-1α-4073 Target: 5'-CTGTGGACCAGGCAAAAAAAAAAAAA-3'      (SEQ ID NO: 3659)

5'-CAGGCAAAAAAAAAAAAAAAAAAaa-3'       (SEQ ID NO: 3136)
                    3'-UGGUCCGUUUUUUUUUUUUUUUUUU-5'       (SEQ ID NO: 2612)

HIF-1α-4079 Target: 5'-ACCAGGCAAAAAAAAAAAAAAAAAAA-3'      (SEQ ID NO: 3660)

5'-CUUUUUCAAGCAGUAGGAAUUAUtt-3'       (SEQ ID NO: 3137)
                    3'-GUGAAAAGUUCGUCAUCCUUAAUAAA-5'      (SEQ ID NO: 2613)

HIF-1α-2610t2 Targ: 5'-CACTTTTTCAAGCAGTAGGAATTATTT-3'     (SEQ ID NO: 3661)

5'-UUUUUCAAGCAGUAGGAAUUAUUta-3'       (SEQ ID NO: 3138)
                    3'-UGAAAAGUUCGUCAUCCUUAAUAAAU-5'      (SEQ ID NO: 2614)

HIF-1α-2611t2 Targ: 5'-ACTTTTTCAAGCAGTAGGAATTATTTA-3'     (SEQ ID NO: 3662)

5'-CAAGCAGUAGGAAUUAUUUAGCAtg-3'       (SEQ ID NO: 3139)
                    3'-AAGUUCGUCAUCCUUAAUAAAUCGUAC-5'     (SEQ ID NO: 2615)

HIF-1α-2616t2 Targ: 5'-TTCAAGCAGTAGGAATTATTTAGCATG-3'     (SEQ ID NO: 3663)

5'-CAGUAGGAAUUAUUUAGCAUGUAga-3'       (SEQ ID NO: 3140)
                    3'-UCGUCAUCCUUAAUAAAUCGUACAUCU-5'     (SEQ ID NO: 2616)

HIF-1α-2620t2 Targ: 5'-AGCAGTAGGAATTATTTAGCATGTAGA-3'     (SEQ ID NO: 3664)

5'-GUAGGAAUUAUUUAGCAUGUAGAct-3'       (SEQ ID NO: 3141)
                    3'-GUCAUCCUUAAUAAAUCGUACAUCUGA-5'     (SEQ ID NO: 2617)

HIF-1α-2622t2 Targ: 5'-CAGTAGGAATTATTTAGCATGTAGACT-3'     (SEQ ID NO: 3665)

5'-UAGGAAUUAUUUAGCAUGUAGACtg-3'       (SEQ ID NO: 3142)
                    3'-UCAUCCUUAAUAAAUCGUACAUCUGAC-5'     (SEQ ID NO: 2618)

HIF-1α-2623t2 Targ: 5'-AGTAGGAATTATTTAGCATGTAGACTG-3'     (SEQ ID NO: 3666)

5'-AGGAAUUAUUUAGCAUGUAGACUgc-3'       (SEQ ID NO: 3143)
                    3'-CAUCCUUAAUAAAUCGUACAUCUGACG-5'     (SEQ ID NO: 2619)

HIF-1α-2624t2 Targ: 5'-GTAGGAATTATTTAGCATGTAGACTGC-3'     (SEQ ID NO: 3667)
```

TABLE 3

Selected Anti-HIF-1α DsiRNAs, Unmodified
Duplexes (Asymmetrics, HIF-1α Variant 1)

```
                    5'-GAAGACAUCGCGGGACCGAUUCAC-3'        (SEQ ID NO: 1135)
                    3'-CACUUCUGUAGCGCCCUGGCUAAGUG-5'      (SEQ ID NO: 27)

HIF-1α-403 Target:  5'-GTGAAGACATCGCGGGACCGATTCAC-3'      (SEQ ID NO: 783)

5'-GUUCUGAACGUCGAAAAGAAAAGUC-3'       (SEQ ID NO: 1136)
                    3'-UUCAAGACUUGCAGCUUUUCUUUUCAG-5'     (SEQ ID NO: 33)

HIF-1α-469 Target:  5'-AAGTTCTGAACGTCGAAAAGAAAAGTC-3'     (SEQ ID NO: 789)

5'-UGAAGUUUUUUAUGAGCUUGCUCAU-3'       (SEQ ID NO: 1137)
                    3'-AGACUUCAAAAAAUACUCGAACGAGUA-5'     (SEQ ID NO: 39)

HIF-1α-530 Target:  5'-TCTGAAGTTTTTTATGAGCTTGCTCAT-3'     (SEQ ID NO: 795)

5'-GUUUUUUAUGAGCUUGCUCAUCAGU-3'       (SEQ ID NO: 1138)
                    3'-UUCAAAAAAUACUCGAACGAGUAGUCA-5'     (SEQ ID NO: 41)

HIF-1α-534 Target:  5'-AAGTTTTTTATGAGCTTGCTCATCAGT-3'     (SEQ ID NO: 797)

5'-UGAAUUGCUUUUAUUUGAAAGCCUU-3'       (SEQ ID NO: 1139)
                    3'-CUACUUAACGAAAAUAAACUUUCGGAA-5'     (SEQ ID NO: 55)
```

TABLE 3-continued

Selected Anti-HIF-1α DsiRNAs, Unmodified
Duplexes (Asymmetrics, HIF-1α Variant 1)

```
HIF-1α-691 Target:   5'-GATGAATTGCTTTTATTTGAAAGCCTT-3'   (SEQ ID NO: 811)

5'-GCCUUGGAUGGUUUUGUUAUGGUUC-3'     (SEQ ID NO: 1140)
                     3'-UUCGGAACCUACCAAAACAAUACCAAG-5'   (SEQ ID NO: 57)

HIF-1α-711 Target:   5'-AAGCCTTGGATGGTTTTGTTATGGTTC-3'   (SEQ ID NO: 813)

5'-CUUGGAUGGUUUUGUUAUGGUUCUC-3'    (SEQ ID NO: 1141)
                     3'-CGGAACCUACCAAAACAAUACCAAGAG-5'  (SEQ ID NO: 58)

HIF-1α-713 Target:   5'-GCCTTGGATGGTTTTGTTATGGTTCTC-3'   (SEQ ID NO: 814)

5'-UGGAUGGUUUUGUUAUGGUUCUCAC-3'    (SEQ ID NO: 1142)
                     3'-GAACCUACCAAAACAAUACCAAGAGUG-5'  (SEQ ID NO: 59)

HIF-1α-715 Target:   5'-CTTGGATGGTTTTGTTATGGTTCTCAC-3'   (SEQ ID NO: 815)

5'-GAUGGUUUUGUUAUGGUUCUCACAG-3'    (SEQ ID NO: 1143)
                     3'-ACCUACCAAAACAAUACCAAGAGUGUC-5'  (SEQ ID NO: 60)

HIF-1α-717 Target:   5'-TGGATGGTTTTGTTATGGTTCTCACAG-3'   (SEQ ID NO: 816)

5'-AUUUACAUUUCUGAUAAUGUGAACA-3'    (SEQ ID NO: 1144)
                     3'-ACUAAAUGUAAAGACUAUUACACUUGU-5'  (SEQ ID NO: 61)

HIF-1α-756 Target:   5'-TGATTTACATTTCTGATAATGTGAACA-3'   (SEQ ID NO: 817)

5'-GUUUGAUUUUACUCAUCCAUGUGAC-3'    (SEQ ID NO: 1145)
                     3'-CACAAACUAAAAUGAGUAGGUACACUG-5'  (SEQ ID NO: 64)

HIF-1α-824 Target:   5'-GTGTTTGATTTTACTCATCCATGTGAC-3'   (SEQ ID NO: 820)

5'-AGUAACCAACCUCAGUGUGGGUAUA-3'    (SEQ ID NO: 1146)
                     3'-UGUCAUUGGUUGGAGUCACACCCAUAU-5'  (SEQ ID NO: 88)

HIF-1α-1041 Target:  5'-ACAGTAACCAACCTCAGTGTGGGTATA-3'   (SEQ ID NO: 844)

5'-UGCUGAUUUGUGAACCCAUUCCUCA-3'    (SEQ ID NO: 1147)
                     3'-CCACGACUAAACACUUGGGUAAGGAGU-5'  (SEQ ID NO: 97)

HIF-1α-1090 Target:  5'-GGTGCTGATTTGTGAACCCATTCCTCA-3'   (SEQ ID NO: 853)

5'-UUAUCAUGCUUUGGACUCUGAUCAU-3'    (SEQ ID NO: 1148)
                     3'-AUAAUAGUACGAAACCUGAGACUAGUA-5'  (SEQ ID NO: 118)

HIF-1α-1262 Target:  5'-TATTATCATGCTTTGGACTCTGATCAT-3'   (SEQ ID NO: 874)

5'-UGCUUUGGACUCUGAUCAUCUGACC-3'    (SEQ ID NO: 1149)
                     3'-GUACGAAACCUGAGACUAGUAGACUGG-5'  (SEQ ID NO: 120)

HIF-1α-1268 Target:  5'-CATGCTTTGGACTCTGATCATCTGACC-3'   (SEQ ID NO: 876)

5'-UUUGGACUCUGAUCAUCUGACCAAA-3'    (SEQ ID NO: 1150)
                     3'-CGAAACCUGAGACUAGUAGACUGGUUU-5'  (SEQ ID NO: 121)

HIF-1α-1271 Target:  5'-GCTTTGGACTCTGATCATCTGACCAAA-3'   (SEQ ID NO: 877)

5'-CAGGAUGCUUGCCAAAAGAGGUGGA-3'    (SEQ ID NO: 1151)
                     3'-AUGUCCUACGAACGGUUUUCUCCACCU-5'  (SEQ ID NO: 145)

HIF-1α-1343 Target:  5'-TACAGGATGCTTGCCAAAAGAGGTGGA-3'   (SEQ ID NO: 901)

5'-AUAUGUCUGGGUUGAAACUCAAGCA-3'    (SEQ ID NO: 1152)
                     3'-CCUAUACAGACCCAACUUUGAGUUCGU-5'  (SEQ ID NO: 157)

HIF-1α-1367 Target:  5'-GGATATGTCTGGGTTGAAACTCAAGCA-3'   (SEQ ID NO: 913)

5'-AUGUCUGGGUUGAAACUCAAGCAAC-3'    (SEQ ID NO: 1153)
                     3'-UAUACAGACCCAACUUUGAGUUCGUUG-5'  (SEQ ID NO: 158)

HIF-1α-1369 Target:  5'-ATATGTCTGGGTTGAAACTCAAGCAAC-3'   (SEQ ID NO: 914)

5'-GUUGAAACUCAAGCAACUGUCAUAU-3'    (SEQ ID NO: 1154)
                     3'-CCCAACUUUGAGUUCGUUGACAGUAUA-5'  (SEQ ID NO: 162)
```

TABLE 3-continued

Selected Anti-HIF-1α DsiRNAs, Unmodified
Duplexes (Asymmetrics, HIF-1α Variant 1)

```
HIF-1α-1377 Target: 5'-GGGTTGAAACTCAAGCAACTGTCATAT-3'  (SEQ ID NO: 918)

5'-UGAAACUCAAGCAACUGUCAUAUAU-3'    (SEQ ID NO: 1155)
                    3'-CAACUUUGAGUUCGUUGACAGUAUAUA-5'  (SEQ ID NO: 163)

HIF-1α-1379 Target: 5'-GTTGAAACTCAAGCAACTGTCATATAT-3'  (SEQ ID NO: 919)

5'-CACGACUUGAUUUUCUCCCUUCAAC-3'    (SEQ ID NO: 1156)
                    3'-UCGUGCUGAACUAAAAGAGGGAAGUUG-5'  (SEQ ID NO: 175)

HIF-1α-1470 Target: 5'-AGCACGACTTGATTTTCTCCCTTCAAC-3'  (SEQ ID NO: 931)

5'-UUGAUUUUCUCCCUUCAACAAACAG-3'    (SEQ ID NO: 1157)
                    3'-UGAACUAAAAGAGGGAAGUUGUUUGUC-5'  (SEQ ID NO: 178)

HIF-1α-1476 Target: 5'-ACTTGATTTTCTCCCTTCAACAAACAG-3'  (SEQ ID NO: 934)

5'-GAUUUUCUCCCUUCAACAAACAGAA-3'    (SEQ ID NO: 1158)
                    3'-AACUAAAAGAGGGAAGUUGUUUGUCUU-5'  (SEQ ID NO: 179)

HIF-1α-1478 Target: 5'-TTGATTTTCTCCCTTCAACAAACAGAA-3'  (SEQ ID NO: 935)

5'-UUCUCCCUUCAACAAACAGAAUGUG-3'    (SEQ ID NO: 1159)
                    3'-AAAAGAGGGAAGUUGUUUGUCUUACAC-5'  (SEQ ID NO: 181)

HIF-1α-1482 Target: 5'-TTTTCTCCCTTCAACAAACAGAATGTG-3'  (SEQ ID NO: 937)

5'-CAAUCAUAUCUUUAGAUUUUGGCAG-3'    (SEQ ID NO: 1160)
                    3'-GUGUUAGUAUAGAAAUCUAAAACCGUC-5'  (SEQ ID NO: 185)

HIF-1α-1648 Target: 5'-CACAATCATATCTTTAGATTTTGGCAG-3'  (SEQ ID NO: 941)

5'-GAAGUUGCAUUAAAAUUAGAACCAA-3'    (SEQ ID NO: 1161)
                    3'-UUCUUCAACGUAAUUUUAAUCUUGGUU-5'  (SEQ ID NO: 194)

HIF-1α-1845 Target: 5'-AAGAAGTTGCATTAAAATTAGAACCAA-3'  (SEQ ID NO: 950)

5'-AAGCACUAGACAAAGUUCACCUGAG-3'    (SEQ ID NO: 1162)
                    3'-CCUUCGUGAUCUGUUUCAAGUGGACUC-5'  (SEQ ID NO: 197)

HIF-1α-1940 Target: 5'-GGAAGCACTAGACAAAGTTCACCTGAG-3'  (SEQ ID NO: 953)

5'-ACUAGACAAAGUUCACCUGAGCCUA-3'    (SEQ ID NO: 1163)
                    3'-CGUGAUCUGUUUCAAGUGGACUCGGAU-5'  (SEQ ID NO: 199)

HIF-1α-1944 Target: 5'-GCACTAGACAAAGTTCACCTGAGCCTA-3'  (SEQ ID NO: 955)

5'-UAGACAAAGUUCACCUGAGCCUAAU-3'    (SEQ ID NO: 1164)
                    3'-UGAUCUGUUUCAAGUGGACUCGGAUUA-5'  (SEQ ID NO: 200)

HIF-1α-1946 Target: 5'-ACTAGACAAAGTTCACCTGAGCCTAAT-3'  (SEQ ID NO: 956)

5'-GUAGAAAAACUUUUUGCUGAAGACA-3'    (SEQ ID NO: 1165)
                    3'-ACCAUCUUUUUGAAAAACGACUUCUGU-5'  (SEQ ID NO: 203)

HIF-1α-2034 Target: 5'-TGGTAGAAAAACTTTTTGCTGAAGACA-3'  (SEQ ID NO: 959)

5'-CAAAAGACAAUUAUUUUAAUACCCU-3'    (SEQ ID NO: 1166)
                    3'-UCGUUUUCUGUUAAUAAAAUUAUGGGA-5'  (SEQ ID NO: 220)

HIF-1α-2730 Target: 5'-AGCAAAAGACAATTATTTTAATACCCT-3'  (SEQ ID NO: 976)

5'-GAUUACCACAGCUGACCAGUUAUGA-3'    (SEQ ID NO: 1167)
                    3'-ACCUAAUGGUGUCGACUGGUCAAUACU-5'  (SEQ ID NO: 223)

HIF-1α-2800 Target: 5'-TGGATTACCACAGCTGACCAGTTATGA-3'  (SEQ ID NO: 979)

5'-CUUUGGAUCAAGUUAACUGAGCUUU-3'    (SEQ ID NO: 1168)
                    3'-UCGAAACCUAGUUCAAUUGACUCGAAA-5'  (SEQ ID NO: 249)

HIF-1α-2890 Target: 5'-AGCTTTGGATCAAGTTAACTGAGCTTT-3'  (SEQ ID NO: 1005)

5'-CAUUCCUUUUUUUGGACACUGGUGG-3'    (SEQ ID NO: 1169)
                    3'-AAGUAAGGAAAAAAACCUGUGACCACC-5'  (SEQ ID NO: 255)
```

TABLE 3-continued

Selected Anti-HIF-1α DsiRNAs, Unmodified
Duplexes (Asymmetrics, HIF-1α Variant 1)

```
HIF-1α-2925 Target: 5'-TTCATTCCTTTTTTTGGACACTGGTGG-3'    (SEQ ID NO: 1011)

5'-UUUUUGGACACUGGUGGCUCAUUAC-3'     (SEQ ID NO: 1170)
                    3'-AAAAAAACCUGUGACCACCGAGUAAUG-5'   (SEQ ID NO: 256)

HIF-1α-2933 Target: 5'-TTTTTTTGGACACTGGTGGCTCATTAC-3'   (SEQ ID NO: 1012)

5'-GCAGUCUAUUUAUAUUUUCUACAUC-3'     (SEQ ID NO: 1171)
                    3'-UUCGUCAGAUAAAUAUAAAGAUGUAG-5'    (SEQ ID NO: 258)

HIF-1α-2963 Target: 5'-AAGCAGTCTATTTATATTTTCTACATC-3'   (SEQ ID NO: 1014)

5'-AGUCUAUUUAUAUUUUCUACAUCUA-3'     (SEQ ID NO: 1172)
                    3'-CGUCAGAUAAAUAUAAAGAUGUAGAU-5'    (SEQ ID NO: 259)

HIF-1α-2965 Target: 5'-GCAGTCTATTTATATTTTCTACATCTA-3'   (SEQ ID NO: 1015)

5'-AUUUAUAUUUUCUACAUCUAAUUUU-3'     (SEQ ID NO: 1173)
                    3'-GAUAAAUAUAAAGAUGUAGAUUAAAA-5'    (SEQ ID NO: 260)

HIF-1α-2970 Target: 5'-CTATTTATATTTTCTACATCTAATTTT-3'   (SEQ ID NO: 1016)

5'-UAAUUUACAUUAAUGCUCUUUUUUA-3'     (SEQ ID NO: 1174)
                    3'-GAAUUAAAUGUAAUUACGAGAAAAAAU-5'   (SEQ ID NO: 271)

HIF-1α-3055 Target: 5'-CTTAATTTACATTAATGCTCTTTTTA-3'    (SEQ ID NO: 1027)

5'-UUUAAUGCUGGAUCACAGACAGCUC-3'     (SEQ ID NO: 1175)
                    3'-AGAAAUUACGACCUAGUGUCUGUCGAG-5'   (SEQ ID NO: 277)

HIF-1α-3088 Target: 5'-TCTTTAATGCTGGATCACAGACAGCTC-3'   (SEQ ID NO: 1033)

5'-CUCAUUUUCUCAGUUUUUUGGUAUU-3'     (SEQ ID NO: 1176)
                    3'-UCGAGUAAAAGAGUCAAAAAACCAUAA-5'   (SEQ ID NO: 279)

HIF-1α-3110 Target: 5'-AGCTCATTTTCTCAGTTTTTTGGTATT-3'   (SEQ ID NO: 1035)

5'-UUUUUUUUCACAUUUUACAUAAAUA-3'     (SEQ ID NO: 1177)
                    3'-GGAAAAAAAAGUGUAAAAUGUAUUUAU-5'   (SEQ ID NO: 294)

HIF-1α-3310 Target: 5'-CCTTTTTTTTCACATTTTACATAAATA-3'   (SEQ ID NO: 1050)

5'-CACAAUUGCACAAUAUAUUUUCUUA-3'     (SEQ ID NO: 1178)
                    3'-CGGUGUUAACGUGUUAUAUAAAAGAAU-5'   (SEQ ID NO: 298)

HIF-1α-3364 Target: 5'-GCCACAATTGCACAATATATTTTCTTA-3'   (SEQ ID NO: 1054)

5'-CAAUUGCACAAUAUAUUUUCUUAAA-3'     (SEQ ID NO: 1179)
                    3'-GUGUUAACGUGUUAUAUAAAAGAAUUU-5'   (SEQ ID NO: 299)

HIF-1α-3366 Target: 5'-CACAATTGCACAATATATTTTCTTAAA-3'   (SEQ ID NO: 1055)

5'-CAAUAUAUUUUCUUAAAAAAUACCA-3'     (SEQ ID NO: 1180)
                    3'-GUGUUAUAUAAAAGAAUUUUUUAUGGU-5'   (SEQ ID NO: 301)

HIF-1α-3374 Target: 5'-CACAATATATTTTCTTAAAAAATACCA-3'   (SEQ ID NO: 1057)

5'-UAAAACUAGUUUUUAAGAAGAAAUU-3'     (SEQ ID NO: 1181)
                    3'-AUAUUUUGAUCAAAAAUUCUUCUUUAA-5'   (SEQ ID NO: 305)

HIF-1α-3430 Target: 5'-TATAAAACTAGTTTTTAAGAAGAAATT-3'   (SEQ ID NO: 1061)

5'-AGAAAUUUUUUUUGGCCUAUGAAAU-3'     (SEQ ID NO: 1182)
                    3'-CUUCUUUAAAAAAAACCGGAUACUUUA-5'   (SEQ ID NO: 307)

HIF-1α-3448 Target: 5'-GAAGAAATTTTTTTTGGCCTATGAAAT-3'   (SEQ ID NO: 1063)

5'-AAAUUUUUUUUGGCCUAUGAAAUUG-3'     (SEQ ID NO: 1183)
                    3'-UCUUUAAAAAAAACCGGAUACUUUAAC-5'   (SEQ ID NO: 308)

HIF-1α-3450 Target: 5'-AGAAATTTTTTTTGGCCTATGAAATTG-3'   (SEQ ID NO: 1064)

5'-UGUGGCAUUUAUUUGGAUAAAAUUC-3'     (SEQ ID NO: 1184)
                    3'-AUACACCGUAAAUAAACCUAUUUUAAG-5'   (SEQ ID NO: 317)
```

TABLE 3-continued

Selected Anti-HIF-1α DsiRNAs, Unmodified
Duplexes (Asymmetrics, HIF-1α Variant 1)

```
HIF-1α-3598  Target: 5'-TATGTGGCATTTATTTGGATAAAATTC-3'    (SEQ ID NO: 1073)

5'-AAAAUUCUCAAUUCAGAGAAAUCAU-3'       (SEQ ID NO: 1185)
                    3'-UAUUUUAAGAGUUAAGUCUCUUUAGUA-5'     (SEQ ID NO: 327)

HIF-1α-3616  Target: 5'-ATAAAATTCTCAATTCAGAGAAATCAT-3'    (SEQ ID NO: 1083)

5'-GUUUCUAUAGUCACUUUGCCAGCUC-3'       (SEQ ID NO: 1186)
                    3'-UACAAAGAUAUCAGUGAAACGGUCGAG-5'     (SEQ ID NO: 329)

HIF-1α-3646  Target: 5'-ATGTTTCTATAGTCACTTTGCCAGCTC-3'    (SEQ ID NO: 1085)

5'-CAAAAGAAAACAAUACCCUAUGUAG-3'       (SEQ ID NO: 1187)
                    3'-GAGUUUUCUUUUGUUAUGGGAUACAUC-5'     (SEQ ID NO: 331)

HIF-1α-3670  Target: 5'-CTCAAAAGAAAACAATACCCTATGTAG-3'    (SEQ ID NO: 1087)

5'-UUCUGCCUACCCUGUUGGUAUAAAG-3'       (SEQ ID NO: 1188)
                    3'-ACAAGACGGAUGGGACAACCAUAUUUC-5'     (SEQ ID NO: 332)

HIF-1α-3743  Target: 5'-TGTTCTGCCTACCCTGTTGGTATAAAG-3'    (SEQ ID NO: 1088)

5'-AGAAAAAAAAAAUCAUGCAUUCUUA-3'       (SEQ ID NO: 1189)
                    3'-GUUCUUUUUUUUUUAGUACGUAAGAAU-5'     (SEQ ID NO: 339)

HIF-1α-3791  Target: 5'-CAAGAAAAAAAAAATCATGCATTCTTA-3'    (SEQ ID NO: 1095)

5'-UUUUAUGCACUUUGUCGCUAUUAAC-3'       (SEQ ID NO: 1190)
                    3'-CUAAAAUACGUGAAACAGCGAUAAUUG-5'     (SEQ ID NO: 341)

HIF-1α-3861  Target: 5'-GATTTTATGCACTTTGTCGCTATTAAC-3'    (SEQ ID NO: 1097)

5'-UUAUGCACUUUGUCGCUAUUAACAU-3'       (SEQ ID NO: 1191)
                    3'-AAAAUACGUGAAACAGCGAUAAUUGUA-5'     (SEQ ID NO: 342)

HIF-1α-3863  Target: 5'-TTTTATGCACTTTGTCGCTATTAACAT-3'    (SEQ ID NO: 1098)

5'-AUUAACAUCCUUUUUUCAUGUAGA-3'        (SEQ ID NO: 1192)
                    3'-GAUAAUUGUAGGAAAAAAGUACAUCU-5'      (SEQ ID NO: 350)

HIF-1α-3880  Target: 5'-CTATTAACATCCTTTTTTCATGTAGA-3'     (SEQ ID NO: 1106)

5'-AAUUUUAGAAGCAUUAUUUUAGGAA-3'       (SEQ ID NO: 1193)
                    3'-CAUUAAAAUCUUCGUAAUAAAAUCCUU-5'     (SEQ ID NO: 353)

HIF-1α-3920  Target: 5'-GTAATTTTAGAAGCATTATTTTAGGAA-3'    (SEQ ID NO: 1109)

5'-UUUUAGAAGCAUUAUUUUAGGAAUA-3'       (SEQ ID NO: 1194)
                    3'-UUAAAAUCUUCGUAAUAAAAUCCUUAU-5'     (SEQ ID NO: 354)

HIF-1α-3922  Target: 5'-AATTTTAGAAGCATTATTTTAGGAATA-3'    (SEQ ID NO: 1110)

5'-UUAGAAGCAUUAUUUUAGGAAUAUA-3'       (SEQ ID NO: 1195)
                    3'-AAAAUCUUCGUAAUAAAAUCCUUAUAU-5'     (SEQ ID NO: 355)

HIF-1α-3924  Target: 5'-TTTTAGAAGCATTATTTTAGGAATATA-3'    (SEQ ID NO: 1111)

5'-UAAAUAUCUUGUUUUUCUAUGUAC-3'        (SEQ ID NO: 1196)
                    3'-UCAUUUAUAGAACAAAAAGAUACAUG-5'      (SEQ ID NO: 359)

HIF-1α-3961  Target: 5'-AGTAAATATCTTGTTTTTCTATGTAC-3'     (SEQ ID NO: 1115)

5'-UUCCUUUUGCUCUUUGUGGUUGGAU-3'       (SEQ ID NO: 1197)
                    3'-GUAAGGAAAACGAGAAACACCAACCUA-5'     (SEQ ID NO: 364)

HIF-1α-4003  Target: 5'-CATTCCTTTTGCTCTTTGTGGTTGGAT-3'    (SEQ ID NO: 1120)

5'-UCCUUUUGCUCUUUGUGGUUGGAUC-3'       (SEQ ID NO: 1198)
                    3'-UAAGGAAAACGAGAAACACCAACCUAG-5'     (SEQ ID NO: 365)

HIF-1α-4004  Target: 5'-ATTCCTTTTGCTCTTTGTGGTTGGATC-3'    (SEQ ID NO: 1121)

5'-CCUUUUGCUCUUUGUGGUUGGAUCU-3'       (SEQ ID NO: 1199)
                    3'-AAGGAAAACGAGAAACACCAACCUAGA-5'     (SEQ ID NO: 366)
```

TABLE 3-continued

Selected Anti-HIF-1α DsiRNAs, Unmodified
Duplexes (Asymmetrics, HIF-1α Variant 1)

```
HIF-1α-4005 Target: 5'-TTCCTTTTGCTCTTTGTGGTTGGATCT-3'      (SEQ ID NO: 1122)

5'-CUUUUGCUCUUUGUGGUUGGAUCUA-3'         (SEQ ID NO: 1200)
                    3'-AGGAAAACGAGAAACACCAACCUAGAU-5'       (SEQ ID NO: 367)

HIF-1α-4006 Target: 5'-TCCTTTTGCTCTTTGTGGTTGGATCTA-3'      (SEQ ID NO: 1123)

5'-UUUUGCUCUUUGUGGUUGGAUCUAA-3'         (SEQ ID NO: 1201)
                    3'-GGAAAACGAGAAACACCAACCUAGAUU-5'       (SEQ ID NO: 368)

HIF-1α-4007 Target: 5'-CCTTTTGCTCTTTGTGGTTGGATCTAA-3'      (SEQ ID NO: 1124)

5'-UUUGCUCUUUGUGGUUGGAUCUAAC-3'         (SEQ ID NO: 1202)
                    3'-GAAAACGAGAAACACCAACCUAGAUUG-5'       (SEQ ID NO: 369)

HIF-1α-4008 Target: 5'-CTTTTGCTCTTTGTGGTTGGATCTAAC-3'      (SEQ ID NO: 1125)

5'-UUGCUCUUUGUGGUUGGAUCUAACA-3'         (SEQ ID NO: 1203)
                    3'-AAAACGAGAAACACCAACCUAGAUUGU-5'       (SEQ ID NO: 370)

HIF-1α-4009 Target: 5'-TTTTGCTCTTTGTGGTTGGATCTAACA-3'      (SEQ ID NO: 1126)

5'-UGCUCUUUGUGGUUGGAUCUAACAC-3'         (SEQ ID NO: 1204)
                    3'-AAACGAGAAACACCAACCUAGAUUGUG-5'       (SEQ ID NO: 371)

HIF-1α-4010 Target: 5'-TTTGCTCTTTGTGGTTGGATCTAACAC-3'      (SEQ ID NO: 1127)

5'-AGAAACCUACUGCAGGGUGAAGAAU-3'         (SEQ ID NO: 1205)
                    3'-CGUCUUUGGAUGACGUCCCACUUCUUA-5'       (SEQ ID NO: 232)

HIF-1α-2856 Target: 5'-GCAGAAACCTACTGCAGGGTGAAGAAT-3'      (SEQ ID NO: 988)

5'-AAUAUUGAAAUUCCUUUAGAUAGCA-3'         (SEQ ID NO: 1206)
                    3'-GUUUAUAACUUUAAGGAAAUCUAUCGU-5'       (SEQ ID NO: 102)

HIF-1α-1122 Target: 5'-CAAATATTGAAATTCCTTTAGATAGCA-3'      (SEQ ID NO: 858)

5'-AAACCUACUGCAGGGUGAAGAAUUA-3'         (SEQ ID NO: 1207)
                    3'-UCUUUGGAUGACGUCCCACUUCUUAAU-5'       (SEQ ID NO: 233)

HIF-1α-2858 Target: 5'-AGAAACCTACTGCAGGGTGAAGAATTA-3'      (SEQ ID NO: 989)

5'-CUACUGCAGGGUGAAGAAUUACUCA-3'         (SEQ ID NO: 1208)
                    3'-UGGAUGACGUCCCACUUCUUAAUGAGU-5'       (SEQ ID NO: 235)

HIF-1α-2862 Target: 5'-ACCTACTGCAGGGTGAAGAATTACTCA-3'      (SEQ ID NO: 991)

5'-UUUUUUUUCACAUUUUACAUAAAUA-3'         (SEQ ID NO: 1209)
                    3'-GGAAAAAAAGUGUAAAAUGUAUUUAU-5'        (SEQ ID NO: 294)

HIF-1α-3310 Target: 5'-CCTTTTTTTTCACATTTTACATAAATA-3'      (SEQ ID NO: 1050)

5'-UCAAGCAACUGUCAUAUAUAACACC-3'         (SEQ ID NO: 1210)
                    3'-UGAGUUCGUUGACAGUAUAUAUUGUGG-5'       (SEQ ID NO: 166)

HIF-1α-1385 Target: 5'-ACTCAAGCAACTGTCATATATAACACC-3'      (SEQ ID NO: 922)

5'-CUUUGGAUCAAGUUAACUGAGCUUU-3'         (SEQ ID NO: 1211)
                    3'-UCGAAACCUAGUUCAAUUGACUCGAAA-5'       (SEQ ID NO: 249)

HIF-1α-2890 Target: 5'-AGCTTTGGATCAAGTTAACTGAGCTTT-3'      (SEQ ID NO: 1005)

5'-CGAAGCUUUUUUCUCAGAAUGAAGU-3'         (SEQ ID NO: 1212)
                    3'-UCGCUUCGAAAAAAGAGUCUUACUUCA-5'       (SEQ ID NO: 79)

HIF-1α-921 Target:  5'-AGCGAAGCTTTTTCTCAGAATGAAGT-3'       (SEQ ID NO: 835)

5'-CUCUUUGUGGUUGGAUCUAACACUA-3'         (SEQ ID NO: 1213)
                    3'-ACGAGAAACACCAACCUAGAUUGUGAU-5'       (SEQ ID NO: 372)

HIF-1α-4012 Target: 5'-TGCTCTTTGTGGTTGGATCTAACACTA-3'      (SEQ ID NO: 1128)

5'-GCAUUAUUUUAGGAAUAUAUAGUUG-3'         (SEQ ID NO: 1214)
                    3'-UUCGUAAUAAAAUCCUUAUAUAUCAAC-5'       (SEQ ID NO: 358)
```

TABLE 3-continued

Selected Anti-HIF-1α DsiRNAs, Unmodified
Duplexes (Asymmetrics, HIF-1α Variant 1)

```
HIF-1α-3930 Target: 5'-AAGCATTATTTTAGGAATATATAGTTG-3'    (SEQ ID NO: 1114)

5'-UUACCACAGCUGACCAGUUAUGAUU-3'      (SEQ ID NO: 1215)
                    3'-CUAAUGGUGUCGACUGGUCAAUACUAA-5'    (SEQ ID NO: 224)

HIF-1α-2802 Target: 5'-GATTACCACAGCTGACCAGTTATGATT-3'    (SEQ ID NO: 980)

5'-AAACUCAAGCAACUGUCAUAUAUAA-3'      (SEQ ID NO: 1216)
                    3'-ACUUUGAGUUCGUUGACAGUAUAUAUU-5'    (SEQ ID NO: 164)

HIF-1α-1381 Target: 5'-TGAAACTCAAGCAACTGTCATATATAA-3'    (SEQ ID NO: 920)

5'-UGGAUUACCACAGCUGACCAGUUAU-3'      (SEQ ID NO: 1217)
                    3'-UCACCUAAUGGUGUCGACUGGUCAAUA-5'    (SEQ ID NO: 222)

HIF-1α-2798 Target: 5'-AGTGGATTACCACAGCTGACCAGTTAT-3'    (SEQ ID NO: 978)

5'-GCAGUCUAUUUAUAUUUUCUACAUC-3'      (SEQ ID NO: 1218)
                    3'-UUCGUCAGAUAAAUAUAAAAGAUGUAG-5'    (SEQ ID NO: 258)

HIF-1α-2963 Target: 5'-AAGCAGTCTATTTATATTTTCTACATC-3'    (SEQ ID NO: 1014)

5'-GAUUUUCUCCCUUCAACAAACAGAA-3'      (SEQ ID NO: 1219)
                    3'-AACUAAAAGAGGGAAGUUGUUUGUCUU-5'    (SEQ ID NO: 179)

HIF-1α-1478 Target: 5'-TTGATTTTCTCCCTTCAACAAACAGAA-3'    (SEQ ID NO: 935)

5'-UUACUCAGAGCUUUGGAUCAAGUUA-3'      (SEQ ID NO: 1220)
                    3'-UUAAUGAGUCUCGAAACCUAGUUCAAU-5'    (SEQ ID NO: 244)

HIF-1α-2880 Target: 5'-AATTACTCAGAGCTTTGGATCAAGTTA-3'    (SEQ ID NO: 1000)

5'-GAGUAAUUUUAGAAGCAUUAUUUUA-3'      (SEQ ID NO: 1221)
                    3'-AACUCAUUAAAAUCUUCGUAAUAAAAU-5'    (SEQ ID NO: 351)

HIF-1α-3916 Target: 5'-TTGAGTAATTTTAGAAGCATTATTTTA-3'    (SEQ ID NO: 1107)

5'-UAAUUUUAGAAGCCUGGCUACAAUA-3'      (SEQ ID NO: 1222)
                    3'-AGAUUAAAAUCUUCGGACCGAUGUUAU-5'    (SEQ ID NO: 262)

HIF-1α-2988 Target: 5'-TCTAATTTTAGAAGCCTGGCTACAATA-3'    (SEQ ID NO: 1018)

5'-AUGCACUUUGUCGCUAUUAACAUCC-3'      (SEQ ID NO: 1223)
                    3'-AAUACGUGAAACAGCGAUAAUUGUAGG-5'    (SEQ ID NO: 343)

HIF-1α-3865 Target: 5'-TTATGCACTTTGTCGCTATTAACATCC-3'    (SEQ ID NO: 1099)

5'-CAGCAGAAACCUACUGCAGGGUGAA-3'      (SEQ ID NO: 1224)
                    3'-CCGUCGUCUUUGGAUGACGUCCCACUU-5'    (SEQ ID NO: 230)

HIF-1α-2852 Target: 5'-GGCAGCAGAAACCTACTGCAGGGTGAA-3'    (SEQ ID NO: 986)

5'-AGAAUUACUCAGAGCUUUGGAUCAA-3'      (SEQ ID NO: 1225)
                    3'-CUUCUUAAUGAGUCUCGAAACCUAGUU-5'    (SEQ ID NO: 242)

HIF-1α-2876 Target: 5'-GAAGAATTACTCAGAGCTTTGGATCAA-3'    (SEQ ID NO: 998)

5'-GAAGAAUUACUCAGAGCUUUGGAUC-3'      (SEQ ID NO: 1226)
                    3'-CACUUCUUAAUGAGUCUCGAAACCUAG-5'    (SEQ ID NO: 241)

HIF-1α-2874 Target: 5'-GTGAAGAATTACTCAGAGCTTTGGATC-3'    (SEQ ID NO: 997)

5'-ACUCAGAGCUUUGGAUCAAGUUAAC-3'      (SEQ ID NO: 1227)
                    3'-AAUGAGUCUCGAAACCUAGUUCAAUUG-5'    (SEQ ID NO: 245)

HIF-1α-2882 Target: 5'-TTACTCAGAGCTTTGGATCAAGTTAAC-3'    (SEQ ID NO: 1001)
```

TABLE 4

Selected Mouse Anti-HIF-1α DsiRNAs (Asymmetrics)

|  |  |  |
|---|---|---|
|  | 5'-CCGCGGGCGCGCGCGUUGGGUGCtg-3' | (SEQ ID NO: 1486) |
|  | 3'-<u>CGG</u>GCGCCCGCGCGCAACCCACGAC-5' | (SEQ ID NO: 1414) |
| HIF-1α-m38 Targ: | 5'-GCCCGCGGGCGCGCGTTGGGTGCTG-3' | (SEQ ID NO: 1558) |
|  | 5'-GCGGGCGCGCGUUGGGUGCUGag-3' | (SEQ ID NO: 1487) |
|  | 3'-<u>GGC</u>GCCCGCGCGCAACCCACGACUC-5' | (SEQ ID NO: 1415) |
| HIF-1α-m40 Targ: | 5'-CCGCGGGCGCGCGTTGGGTGCTGAG-3' | (SEQ ID NO: 1559) |
|  | 5'-CGGGCGCGCGUUGGGUGCUGAgc-3' | (SEQ ID NO: 1488) |
|  | 3'-<u>GCG</u>CCCGCGCGCAACCCACGACUCG-5' | (SEQ ID NO: 1416) |
| HIF-1α-m41 Targ: | 5'-CGCGGGCGCGCGTTGGGTGCTGAGC-3' | (SEQ ID NO: 1560) |
|  | 5'-GGGCGCGCGUUGGGUGCUGAGcg-3' | (SEQ ID NO: 1489) |
|  | 3'-<u>CGC</u>CCGCGCGCAACCCACGACUCGC-5' | (SEQ ID NO: 1417) |
| HIF-1α-m42 Targ: | 5'-GCGGGCGCGCGTTGGGTGCTGAGCG-3' | (SEQ ID NO: 1561) |
|  | 5'-GGCGCGCGUUGGGUGCUGAGCgg-3' | (SEQ ID NO: 1490) |
|  | 3'-<u>GCC</u>CGCGCGCAACCCACGACUCGCC-5' | (SEQ ID NO: 1418) |
| HIF-1α-m43 Targ: | 5'-CGGGCGCGCGTTGGGTGCTGAGCGG-3' | (SEQ ID NO: 1562) |
|  | 5'-GCGCGCGCGUUGGGUGCUGAGCGgg-3' | (SEQ ID NO: 1491) |
|  | 3'-<u>CCC</u>GCGCGCAACCCACGACUCGCCC-5' | (SEQ ID NO: 1419) |
| HIF-1α-m44 Targ: | 5'-GGGCGCGCGTTGGGTGCTGAGCGGG-3' | (SEQ ID NO: 1563) |
|  | 5'-CGCGCGCGUUGGGUGCUGAGCGGgc-3' | (SEQ ID NO: 1492) |
|  | 3'-<u>CCG</u>CGCGCAACCCACGACUCGCCCG-5' | (SEQ ID NO: 1420) |
| HIF-1α-m45 Targ: | 5'-GGCGCGCGCGTTGGGTGCTGAGCGGGC-3' | (SEQ ID NO: 1564) |
|  | 5'-GCGCGCGUUGGGUGCUGAGCGGGcg-3' | (SEQ ID NO: 1493) |
|  | 3'-<u>CGC</u>GCGCGCAACCCACGACUCGCCCGC-5' | (SEQ ID NO: 1421) |
| HIF-1α-m46 Targ: | 5'-GCGCGCGCGTTGGGTGCTGAGCGGGCG-3' | (SEQ ID NO: 1565) |
|  | 5'-CGCGCGUUGGGUGCUGAGCGGGCgc-3' | (SEQ ID NO: 1494) |
|  | 3'-<u>GCG</u>CGCGCAACCCACGACUCGCCCGCG-5' | (SEQ ID NO: 1422) |
| HIF-1α-m47 Targ: | 5'-CGCGCGCGTTGGGTGCTGAGCGGGCGC-3' | (SEQ ID NO: 1566) |
|  | 5'-CGCGUUGGGUGCUGAGCGGGCGCgc-3' | (SEQ ID NO: 1495) |
|  | 3'-<u>GCG</u>CGCAACCCACGACUCGCCCGCGCG-5' | (SEQ ID NO: 1423) |
| HIF-1α-m49 Targ: | 5'-CGCGCGTTGGGTGCTGAGCGGGCGCGC-3' | (SEQ ID NO: 1567) |
|  | 5'-GCGUUGGGUGCUGAGCGGGCGCGcg-3' | (SEQ ID NO: 1496) |
|  | 3'-<u>CGC</u>GCAACCCACGACUCGCCCGCGCGC-5' | (SEQ ID NO: 1424) |
| HIF-1α-m50 Targ: | 5'-GCGCGTTGGGTGCTGAGCGGGCGCGCG-3' | (SEQ ID NO: 1568) |
|  | 5'-CGUUGGGUGCUGAGCGGGCGCGCgc-3' | (SEQ ID NO: 1497) |
|  | 3'-<u>GCG</u>CAACCCACGACUCGCCCGCGCGCG-5' | (SEQ ID NO: 1425) |
| HIF-1α-m51 Targ: | 5'-CGCGTTGGGTGCTGAGCGGGCGCGCGC-3' | (SEQ ID NO: 1569) |
|  | 5'-GUUGGGUGCUGAGCGGGCGCGCGca-3' | (SEQ ID NO: 1498) |
|  | 3'-<u>CGC</u>AACCCACGACUCGCCCGCGCGCGU-5' | (SEQ ID NO: 1426) |
| HIF-1α-m52 Targ: | 5'-GCGTTGGGTGCTGAGCGGGCGCGCGCA-3' | (SEQ ID NO: 1570) |
|  | 5'-UUGGGUGCUGAGCGGGCGCGCGCac-3' | (SEQ ID NO: 1499) |
|  | 3'-<u>GCA</u>ACCCACGACUCGCCCGCGCGCGUG-5' | (SEQ ID NO: 1427) |
| HIF-1α-m53 Targ: | 5'-CGTTGGGTGCTGAGCGGGCGCGCGCAC-3' | (SEQ ID NO: 1571) |
|  | 5'-GGGUGCUGAGCGGGCGCGCGCACcc-3' | (SEQ ID NO: 1500) |
|  | 3'-<u>AA</u>CCCACGACUCGCCCGCGCGCGUGGG-5' | (SEQ ID NO: 1428) |
| HIF-1α-m55 Targ: | 5'-TTGGGTGCTGAGCGGGCGCGCGCACCC-3' | (SEQ ID NO: 1572) |
|  | 5'-CUCGCCGCGCGCCCGAGCGCGCCtc-3' | (SEQ ID NO: 1501) |
|  | 3'-<u>GGG</u>AGCGGCGCGCGGGCUCGCGCGGAG-5' | (SEQ ID NO: 1429) |

TABLE 4-continued

Selected Mouse Anti-HIF-1α DsiRNAs (Asymmetrics)

| | | |
|---|---|---|
| HIF-1α-m97 Targ: | 5'-CCCTCGCCGCGCGCCCGAGCGCGCCTC-3' | (SEQ ID NO: 1573) |
| | 5'-UCGCCGCGCGCCCGAGCGCGCCUcc-3'<br>3'-GGAGCGGCGCGCGGGCUCGCGCGGAGG-5' | (SEQ ID NO: 1502)<br>(SEQ ID NO: 1430) |
| HIF-1α-m98 Targ: | 5'-CCTCGCCGCGCGCCCGAGCGCGCCTCC-3' | (SEQ ID NO: 1574) |
| | 5'-CGCCGCGCGCCCGAGCGCGCCUCcg-3'<br>3'-GAGCGGCGCGCGGGCUCGCGCGGAGGC-5' | (SEQ ID NO: 1503)<br>(SEQ ID NO: 1431) |
| HIF-1α-m99 Targ: | 5'-CTCGCCGCGCGCCCGAGCGCGCCTCCG-3' | (SEQ ID NO: 1575) |
| | 5'-GCCGCGCGCCCGAGCGCGCCUCCgc-3'<br>3'-AGCGGCGCGCGGGCUCGCGCGGAGGCG-5' | (SEQ ID NO: 1504)<br>(SEQ ID NO: 1432) |
| HIF-1α-m100 Targ: | 5'-TCGCCGCGCGCCCGAGCGCGCCTCCGC-3' | (SEQ ID NO: 1576) |
| | 5'-UGCCGCUGCUUCAGCGCCUCAGUgc-3'<br>3'-GGACGGCGACGAAGUCGCGGAGUCACG-5' | (SEQ ID NO: 1505)<br>(SEQ ID NO: 1433) |
| HIF-1α-m139 Targ: | 5'-CCTGCCGCTGCTTCAGCGCCTCAGTGC-3' | (SEQ ID NO: 1577) |
| | 5'-CCGCUGCUUCAGCGCCUCAGUGCac-3'<br>3'-ACGGCGACGAAGUCGCGGAGUCACGUG-5' | (SEQ ID NO: 1506)<br>(SEQ ID NO: 1434) |
| HIF-1α-m141 Targ: | 5'-TGCCGCTGCTTCAGCGCCTCAGTGCAC-3' | (SEQ ID NO: 1578) |
| | 5'-UGCUUCAGCGCCUCAGUGCACAGag-3'<br>3'-CGACGAAGUCGCGGAGUCACGUGUCUC-5' | (SEQ ID NO: 1507)<br>(SEQ ID NO: 1435) |
| HIF-1α-m145 Targ: | 5'-GCTGCTTCAGCGCCTCAGTGCACAGAG-3' | (SEQ ID NO: 1579) |
| | 5'-GCUUCAGCGCCUCAGUGCACAGAgc-3'<br>3'-GACGAAGUCGCGGAGUCACGUGUCUCG-5' | (SEQ ID NO: 1508)<br>(SEQ ID NO: 1436) |
| HIF-1α-m146 Targ: | 5'-CTGCTTCAGCGCCTCAGTGCACAGAGC-3' | (SEQ ID NO: 1580) |
| | 5'-UUCAGCGCCUCAGUGCACAGAGCct-3'<br>3'-CGAAGUCGCGGAGUCACGUGUCUCGGA-5' | (SEQ ID NO: 1509)<br>(SEQ ID NO: 1437) |
| HIF-1α-m148 Targ: | 5'-GCTTCAGCGCCTCAGTGCACAGAGCCT-3' | (SEQ ID NO: 1581) |
| | 5'-GCGCCUCAGUGCACAGAGCCUCCtc-3'<br>3'-GUCGCGGAGUCACGUGUCUCGGAGGAG-5' | (SEQ ID NO: 1510)<br>(SEQ ID NO: 1438) |
| HIF-1α-m152 Targ: | 5'-CAGCGCCTCAGTGCACAGAGCCTCCTC-3' | (SEQ ID NO: 1582) |
| | 5'-GCCGGAGCUCAGCGAGCGCAGCCtg-3'<br>3'-CUCGGCCUCGAGUCGCUCGCGUCGGAC-5' | (SEQ ID NO: 1511)<br>(SEQ ID NO: 1439) |
| HIF-1α-m271 Targ: | 5'-GAGCCGGAGCTCAGCGAGCGCAGCCTG-3' | (SEQ ID NO: 1583) |
| | 5'-GCUCAGCGAGCGCAGCCUGCAGCtc-3'<br>3'-CUCGAGUCGCUCGCGUCGGACGUCGAG-5' | (SEQ ID NO: 1512)<br>(SEQ ID NO: 1440) |
| HIF-1α-m277 Targ: | 5'-GAGCTCAGCGAGCGCAGCCTGCAGCTC-3' | (SEQ ID NO: 1584) |
| | 5'-GCGAGCGCAGCCUGCAGCUCCCGcc-3'<br>3'-GUCGCUCGCGUCGGACGUCGAGGGCGG-5' | (SEQ ID NO: 1513)<br>(SEQ ID NO: 1441) |
| HIF-1α-m282 Targ: | 5'-CAGCGAGCGCAGCCTGCAGCTCCCGCC-3' | (SEQ ID NO: 1585) |
| | 5'-CGAGCGCAGCCUGCAGCUCCCGCct-3'<br>3'-UCGCUCGCGUCGGACGUCGAGGGCGGA-5' | (SEQ ID NO: 1514)<br>(SEQ ID NO: 1442) |
| HIF-1α-m283 Targ: | 5'-AGCGAGCGCAGCCTGCAGCTCCCGCCT-3' | (SEQ ID NO: 1586) |
| | 5'-GAGCGCAGCCUGCAGCUCCCGCCtc-3'<br>3'-CGCUCGCGUCGGACGUCGAGGGCGGAG-5' | (SEQ ID NO: 1515)<br>(SEQ ID NO: 1443) |
| HIF-1α-m284 Targ: | 5'-GCGAGCGCAGCCTGCAGCTCCCGCCTC-3' | (SEQ ID NO: 1587) |
| | 5'-GCGCAGCCUGCAGCUCCCGCCUCgc-3'<br>3'-CUCGCGUCGGACGUCGAGGGCGGAGCG-5' | (SEQ ID NO: 1516)<br>(SEQ ID NO: 1444) |

TABLE 4-continued

Selected Mouse Anti-HIF-1α DsiRNAs (Asymmetrics)

```
HIF-1α-m286 Targ: 5'-GAGCGCAGCCTGCAGCTCCCGCCTCGC-3'      (SEQ ID NO: 1588)

5'-CAGCCUGCAGCUCCCGCCUCGCCgt-3'       (SEQ ID NO: 1517)
                  3'-GCGUCGGACGUCGAGGGCGGAGCGGCA-5'     (SEQ ID NO: 1445)

HIF-1α-m289 Targ: 5'-CGCAGCCTGCAGCTCCCGCCTCGCCGT-3'      (SEQ ID NO: 1589)

5'-GACUUGUCUCUUUCUCCGCGCGCgc-3'       (SEQ ID NO: 1518)
                  3'-ACCUGAACAGAGAAAGAGGCGCGCGCG-5'     (SEQ ID NO: 1446)

HIF-1α-m348 Targ: 5'-TGGACTTGTCTCTTTCTCCGCGCGCGC-3'      (SEQ ID NO: 1590)

5'-CUUGUCUCUUUCUCCGCGCGCGCgg-3'       (SEQ ID NO: 1519)
                  3'-CUGAACAGAGAAAGAGGCGCGCGCGCC-5'     (SEQ ID NO: 1447)

HIF-1α-m350 Targ: 5'-GACTTGTCTCTTTCTCCGCGCGCGCGG-3'      (SEQ ID NO: 1591)

5'-UGUCUCUUUCUCCGCGCGCGCGGac-3'       (SEQ ID NO: 1520)
                  3'-GAACAGAGAAAGAGGCGCGCGCGCCUG-5'     (SEQ ID NO: 1448)

HIF-1α-m352 Targ: 5'-CTTGTCTCTTTCTCCGCGCGCGCGGAC-3'      (SEQ ID NO: 1592)

5'-GUCUCUUUCUCCGCGCGCGCGGAca-3'       (SEQ ID NO: 1521)
                  3'-AACAGAGAAAGAGGCGCGCGCGCCUGU-5'     (SEQ ID NO: 1449)

HIF-1α-m353 Targ: 5'-TTGTCTCTTTCTCCGCGCGCGCGGACA-3'      (SEQ ID NO: 1593)

5'-UCUCUUUCUCCGCGCGCGCGGACag-3'       (SEQ ID NO: 1522)
                  3'-ACAGAGAAAGAGGCGCGCGCGCCUGUC-5'     (SEQ ID NO: 1450)

HIF-1α-m354 Targ: 5'-TGTCTCTTTCTCCGCGCGCGCGGACAG-3'      (SEQ ID NO: 1594)

5'-CUUUCUCCGCGCGCGCGGACAGAgc-3'       (SEQ ID NO: 1523)
                  3'-GAGAAAGAGGCGCGCGCGCCUGUCUCG-5'     (SEQ ID NO: 1451)

HIF-1α-m357 Targ: 5'-CTCTTTCTCCGCGCGCGCGGACAGAGC-3'      (SEQ ID NO: 1595)

5'-UUCUCCGCGCGCGCGGACAGAGCcg-3'       (SEQ ID NO: 1524)
                  3'-GAAAGAGGCGCGCGCGCCUGUCUCGGC-5'     (SEQ ID NO: 1452)

HIF-1α-m359 Targ: 5'-CTTTCTCCGCGCGCGCGGACAGAGCCG-3'      (SEQ ID NO: 1596)

5'-GCGCGCGCGGACAGAGCCGGCGUtt-3'       (SEQ ID NO: 1525)
                  3'-GGCGCGCGCGCCUGUCUCGGCCGCAAA-5'     (SEQ ID NO: 1453)

HIF-1α-m365 Targ: 5'-CCGCGCGCGCGGACAGAGCCGGCGTTT-3'      (SEQ ID NO: 1597)

5'-GAGCUCACAUCUUGAUAAAGCUUct-3'       (SEQ ID NO: 1526)
                  3'-CACUCGAGUGUAGAACUAUUUCGAAGA-5'     (SEQ ID NO: 1454)

HIF-1α-m597 Targ: 5'-GTGAGCTCACATCTTGATAAAGCTTCT-3'      (SEQ ID NO: 1598)

5'-CUCACAUCUUGAUAAAGCUUCUGtt-3'       (SEQ ID NO: 1527)
                  3'-UCGAGUGUAGAACUAUUUCGAAGACAA-5'     (SEQ ID NO: 1455)

HIF-1α-m600 Targ: 5'-AGCTCACATCTTGATAAAGCTTCTGTT-3'      (SEQ ID NO: 1599)

5'-GACUGUUUUUAUCUGAAAGCCCUag-3'       (SEQ ID NO: 1528)
                  3'-ACCUGACAAAAAUAGACUUUCGGGAUC-5'     (SEQ ID NO: 1456)

HIF-1α-m712 Targ: 5'-TGGACTGTTTTTATCTGAAAGCCCTAG-3'      (SEQ ID NO: 1600)

5'-CCCAUGACGUGCUUGGUGCUGAUtt-3'       (SEQ ID NO: 1529)
                  3'-GUGGGUACUGCACGAACCACGACUAAA-5'     (SEQ ID NO: 1457)

HIF-1α-m1093 Targ:5'-CACCCATGACGTGCTTGGTGCTGATTT-3'      (SEQ ID NO: 1601)

5'-UACAAGCUGCCUUUUUGAUAAGCtt-3'       (SEQ ID NO: 1530)
                  3'-CUAUGUUCGACGGAAAAACUAUUCGAA-5'     (SEQ ID NO: 1458)

HIF-1α-m1593 Targ:5'-GATACAAGCTGCCTTTTTGATAAGCTT-3'      (SEQ ID NO: 1602)

5'-CAAGCUGCCUUUUUGAUAAGCUUaa-3'       (SEQ ID NO: 1531)
                  3'-AUGUUCGACGGAAAAACUAUUCGAAUU-5'     (SEQ ID NO: 1459)
```

TABLE 4-continued

Selected Mouse Anti-HIF-1α DsiRNAs (Asymmetrics)

```
HIF-1α-m1595  Targ: 5'-TACAAGCTGCCTTTTTGATAAGCTTAA-3'    (SEQ ID NO: 1603)

5'-AAGCUGCCUUUUUGAUAAGCUUAag-3'      (SEQ ID NO: 1532)
                    3'-UGUUCGACGGAAAAACUAUUCGAAUUC-5'    (SEQ ID NO: 1460)

HIF-1α-m1596  Targ: 5'-ACAAGCTGCCTTTTTGATAAGCTTAAG-3'    (SEQ ID NO: 1604)

5'-CUGCCUUUUUGAUAAGCUUAAGAag-3'      (SEQ ID NO: 1533)
                    3'-UCGACGGAAAAACUAUUCGAAUUCUUC-5'    (SEQ ID NO: 1461)

HIF-1α-m1599  Targ: 5'-AGCTGCCTTTTTGATAAGCTTAAGAAG-3'    (SEQ ID NO: 1605)

5'-UGCUCUCACUCUGCUGGCUCCAGct-3'      (SEQ ID NO: 1534)
                    3'-CUACGAGAGUGAGACGACCGAGGUCGA-5'    (SEQ ID NO: 1462)

HIF-1α-m1632  Targ: 5'-GATGCTCTCACTCTGCTGGCTCCAGCT-3'    (SEQ ID NO: 1606)

5'-GCUCUCACUCUGCUGGCUCCAGCtg-3'      (SEQ ID NO: 1535)
                    3'-UACGAGAGUGAGACGACCGAGGUCGAC-5'    (SEQ ID NO: 1463)

HIF-1α-m1633  Targ: 5'-ATGCTCTCACTCTGCTGGCTCCAGCTG-3'    (SEQ ID NO: 1607)

5'-CUCUCACUCUGCUGGCUCCAGCUgc-3'      (SEQ ID NO: 1536)
                    3'-ACGAGAGUGAGACGACCGAGGUCGACG-5'    (SEQ ID NO: 1464)

HIF-1α-m1634  Targ: 5'-TGCTCTCACTCTGCTGGCTCCAGCTGC-3'    (SEQ ID NO: 1608)

5'-CUGCUGGCUCCAGCUGCCGGCGAca-3'      (SEQ ID NO: 1537)
                    3'-GAGACGACCGAGGUCGACGGCCGCUGU-5'    (SEQ ID NO: 1465)

HIF-1α-m1642  Targ: 5'-CTCTGCTGGCTCCAGCTGCCGGCGACA-3'    (SEQ ID NO: 1609)

5'-UCGAAGUAGUGCUGAUCCUGCACtg-3'      (SEQ ID NO: 1538)
                    3'-GAAGCUUCAUCACGACUAGGACGUGAC-5'    (SEQ ID NO: 1466)

HIF-1α-m1830  Targ: 5'-CTTCGAAGTAGTGCTGATCCTGCACTG-3'    (SEQ ID NO: 1610)

5'-UAUUGCUUUGAUGUGGAUAGCGAta-3'      (SEQ ID NO: 1539)
                    3'-UUAUAACGAAACUACACCUAUCGCUAU-5'    (SEQ ID NO: 1467)

HIF-1α-m2041  Targ: 5'-AATATTGCTTTGATGTGGATAGCGATA-3'    (SEQ ID NO: 1611)

5'-UUGCUUUGAUGUGGAUAGCGAUAtg-3'      (SEQ ID NO: 1540)
                    3'-AUAACGAAACUACACCUAUCGCUAUAC-5'    (SEQ ID NO: 1468)

HIF-1α-m2043  Targ: 5'-TATTGCTTTGATGTGGATAGCGATATG-3'    (SEQ ID NO: 1612)

5'-GCUUUGAUGUGGAUAGCGAUAUGgt-3'      (SEQ ID NO: 1541)
                    3'-AACGAAACUACACCUAUCGCUAUACCA-5'    (SEQ ID NO: 1469)

HIF-1α-m2045  Targ: 5'-TTGCTTTGATGTGGATAGCGATATGGT-3'    (SEQ ID NO: 1613)

5'-GAUGGCUCCCUUUUUCAAGCAGCag-3'      (SEQ ID NO: 1542)
                    3'-UACUACCGAGGGAAAAAGUUCGUCGUC-5'    (SEQ ID NO: 1470)

HIF-1α-m2650  Targ: 5'-ATGATGGCTCCCTTTTTCAAGCAGCAG-3'    (SEQ ID NO: 1614)

5'-UUCUGUUGGUUAUUUUUGGACACtg-3'      (SEQ ID NO: 1543)
                    3'-CAAAGACAACCAAUAAAAACCUGUGAC-5'    (SEQ ID NO: 1471)

HIF-1α-m3030  Targ: 5'-GTTTCTGTTGGTTATTTTTGGACACTG-3'    (SEQ ID NO: 1615)

5'-UUAAGCCUGGAUCAUGAAGCUGUtg-3'      (SEQ ID NO: 1544)
                    3'-ACAAUUCGGACCUAGUACUUCGACAAC-5'    (SEQ ID NO: 1472)

HIF-1α-m3557  Targ: 5'-TGTTAAGCCTGGATCATGAAGCTGTTG-3'    (SEQ ID NO: 1616)

5'-CCUGGAUCAUGAAGCUGUUGAUCtt-3'      (SEQ ID NO: 1545)
                    3'-UCGGACCUAGUACUUCGACAACUAGAA-5'    (SEQ ID NO: 1473)

HIF-1α-m3562  Targ: 5'-AGCCTGGATCATGAAGCTGTTGATCTT-3'    (SEQ ID NO: 1617)

5'-CUGUUGAUCUUAUAAUGAUUCUUaa-3'      (SEQ ID NO: 1546)
                    3'-UCGACAACUAGAAUAUUACUAAGAAUU-5'    (SEQ ID NO: 1474)
```

TABLE 4-continued

Selected Mouse Anti-HIF-1α DsiRNAs (Asymmetrics)

```
HIF-1α-m3576 Targ: 5'-AGCTGTTGATCTTATAATGATTCTTAA-3'    (SEQ ID NO: 1618)

5'-GAUUCUUAAACUGUAUGGUUUCUtt-3'      (SEQ ID NO: 1547)
                   3'-UACUAAGAAUUUGACAUACCAAAGAAA-5'    (SEQ ID NO: 1475)

HIF-1α-m3592 Targ: 5'-ATGATTCTTAAACTGTATGGTTTCTTT-3'    (SEQ ID NO: 1619)

5'-GUAUGGUUUCUUUAUAUGGGUAAag-3'     (SEQ ID NO: 1548)
                   3'-GACAUACCAAAGAAAUAUACCCAUUUC-5'    (SEQ ID NO: 1476)

HIF-1α-m3604 Targ: 5'-CTGTATGGTTTCTTTATATGGGTAAAG-3'    (SEQ ID NO: 1620)

5'-UAGUAAACAUCUUGUUUUUCUAtg-3'      (SEQ ID NO: 1549)
                   3'-GUAUCAUUUGUAGAACAAAAAAGAUAC-5'    (SEQ ID NO: 1477)

HIF-1α-m4023 Targ: 5'-CATAGTAAACATCTTGTTTTTTCTATG-3'    (SEQ ID NO: 1621)

5'-UUCGUUCCCUUGCUCUUUGUGGUtg-3'     (SEQ ID NO: 1550)
                   3'-AAAAGCAAGGGAACGAGAAACACCAAC-5'    (SEQ ID NO: 1478)

HIF-1α-m4064 Targ: 5'-TTTTCGTTCCCTTGCTCTTTGTGGTTG-3'    (SEQ ID NO: 1622)

5'-UCGUUCCCUUGCUCUUUGUGGUUgg-3'     (SEQ ID NO: 1551)
                   3'-AAAGCAAGGGAACGAGAAACACCAACC-5'    (SEQ ID NO: 1479)

HIF-1α-m4065 Targ: 5'-TTTCGTTCCCTTGCTCTTTGTGGTTGG-3'    (SEQ ID NO: 1623)

5'-CCCUUGCUCUUUGUGGUUGGGUCta-3'     (SEQ ID NO: 1552)
                   3'-AAGGGAACGAGAAACACCAACCCAGAU-5'    (SEQ ID NO: 1480)

HIF-1α-m4070 Targ: 5'-TTCCCTTGCTCTTTGTGGTTGGGTCTA-3'    (SEQ ID NO: 1624)

5'-UCCGCGCUCUCAGGGAGCUAUGUgg-3'     (SEQ ID NO: 1553)
                   3'-AAAGGCGCGAGAGUCCCUCGAUACACC-5'    (SEQ ID NO: 1481)

HIF-1α-m4549 Targ: 5'-TTTCCGCGCTCTCAGGGAGCTATGTGG-3'    (SEQ ID NO: 1625)

5'-CUGAUGUUUCUUUACUUUGCCAGct-3'     (SEQ ID NO: 1554)
                   3'-UGGACUACAAAGAAAUGAAACGGUCGA-5'    (SEQ ID NO: 1482)

HIF-1α-m4691 Targ: 5'-ACCTGATGTTTCTTTACTTTGCCAGCT-3'    (SEQ ID NO: 1626)

5'-UGAUGUUUCUUUACUUUGCCAGCtt-3'    (SEQ ID NO: 1555)
                   3'-GGACUACAAAGAAAUGAAACGGUCGAA-5'    (SEQ ID NO: 1483)

HIF-1α-m4692 Targ: 5'-CCTGATGTTTCTTTACTTTGCCAGCTT-3'    (SEQ ID NO: 1627)

5'-GAUGUUUCUUUACUUUGCCAGCUtt-3'    (SEQ ID NO: 1556)
                   3'-GACUACAAAGAAAUGAAACGGUCGAAA-5'    (SEQ ID NO: 1484)

HIF-1α-m4693 Targ: 5'-CTGATGTTTCTTTACTTTGCCAGCTTT-3'    (SEQ ID NO: 1628)

5'-GCCAGCUUUAAAAAAGUAUCUUAtg-3'     (SEQ ID NO: 1557)
                   3'-AACGGUCGAAAUUUUUUCAUAGAAUAC-5'    (SEQ ID NO: 1485)

HIF-1α-m4709 Targ: 5'-TTGCCAGCTTTAAAAAAGTATCTTATG-3'    (SEQ ID NO: 1629)
```

Projected 21 nucleotide target sequences for each DsiRNA of Tables 2-4 above and of Tables 6 and 7 below are presented in Table 5.

TABLE 5

DsiRNA Target Sequences (21mers) In HIF-1α mRNA

```
HIF-1α-81  21 nt Targ:   5'-CCGCGCGCCCGAGCGCGCCUC-3'   (SEQ ID NO: 1630)

HIF-1α-83  21 nt Targ:   5'-GCGCGCCCGAGCGCGCCUCCG-3'   (SEQ ID NO: 1631)

HIF-1α-85  21 nt Targ:   5'-GCGCCCGAGCGCGCCUCCGCC-3'   (SEQ ID NO: 1632)

HIF-1α-87  21 nt Targ:   5'-GCCCGAGCGCGCCUCCGCCCU-3'   (SEQ ID NO: 1633)

HIF-1α-89  21 nt Targ:   5'-CCGAGCGCGCCUCCGCCCUUG-3'   (SEQ ID NO: 1634)
```

TABLE 5-continued

DsiRNA Target Sequences (21mers) In HIF-1α mRNA

| | | |
|---|---|---|
| HIF-1α-123 21 nt Targ: | 5'-GCUGCCUCAGCUCCUCAGUGC-3' | (SEQ ID NO: 1635) |
| HIF-1α-124 21 nt Targ: | 5'-CUGCCUCAGCUCCUCAGUGCA-3' | (SEQ ID NO: 1636) |
| HIF-1α-126 21 nt Targ: | 5'-GCCUCAGCUCCUCAGUGCACA-3' | (SEQ ID NO: 1637) |
| HIF-1α-130 21 nt Targ: | 5'-CAGCUCCUCAGUGCACAGUGC-3' | (SEQ ID NO: 1638) |
| HIF-1α-131 21 nt Targ: | 5'-AGCUCCUCAGUGCACAGUGCU-3' | (SEQ ID NO: 1639) |
| HIF-1α-147 21 nt Targ: | 5'-GUGCUGCCUCGUCUGAGGGGA-3' | (SEQ ID NO: 1640) |
| HIF-1α-265 21 nt Targ: | 5'-GAUUGCCGCCCGCUUCUCUCU-3' | (SEQ ID NO: 1641) |
| HIF-1α-267 21 nt Targ: | 5'-UUGCCGCCCGCUUCUCUCUAG-3' | (SEQ ID NO: 1642) |
| HIF-1α-268 21 nt Targ: | 5'-UGCCGCCCGCUUCUCUCUAGU-3' | (SEQ ID NO: 1643) |
| HIF-1α-292 21 nt Targ: | 5'-ACGAGGGGUUUCCCGCCUCGC-3' | (SEQ ID NO: 1644) |
| HIF-1α-319 21 nt Targ: | 5'-ACCUCUGGACUUGCCUUUCCU-3' | (SEQ ID NO: 1645) |
| HIF-1α-322 21 nt Targ: | 5'-UCUGGACUUGCCUUUCCUUCU-3' | (SEQ ID NO: 1646) |
| HIF-1α-324 21 nt Targ: | 5'-UGGACUUGCCUUUCCUUCUCU-3' | (SEQ ID NO: 1647) |
| HIF-1α-327 21 nt Targ: | 5'-ACUUGCCUUUCCUUCUCUUCU-3' | (SEQ ID NO: 1648) |
| HIF-1α-329 21 nt Targ: | 5'-UUGCCUUUCCUUCUCUUCUCC-3' | (SEQ ID NO: 1649) |
| HIF-1α-330 21 nt Targ: | 5'-UGCCUUUCCUUCUCUUCUCCG-3' | (SEQ ID NO: 1650) |
| HIF-1α-331 21 nt Targ: | 5'-GCCUUUCCUUCUCUUCUCCGC-3' | (SEQ ID NO: 1651) |
| HIF-1α-342 21 nt Targ: | 5'-UCUUCUCCGCGUGUGGAGGGA-3' | (SEQ ID NO: 1652) |
| HIF-1α-344 21 nt Targ: | 5'-UUCUCCGCGUGUGGAGGGAGC-3' | (SEQ ID NO: 1653) |
| HIF-1α-346 21 nt Targ: | 5'-CUCCGCGUGUGGAGGGAGCCA-3' | (SEQ ID NO: 1654) |
| HIF-1α-359 21 nt Targ: | 5'-GGGAGCCAGCGCUUAGGCCGG-3' | (SEQ ID NO: 1655) |
| HIF-1α-403 21 nt Targ: | 5'-GUGAAGACAUCGCGGGGACCG-3' | (SEQ ID NO: 1656) |
| HIF-1α-422 21 nt Targ: | 5'-CGAUUCACCAUGGAGGGCGCC-3' | (SEQ ID NO: 1657) |
| HIF-1α-427 21 nt Targ: | 5'-CACCAUGGAGGGCGCCGGCGG-3' | (SEQ ID NO: 1658) |
| HIF-1α-429 21 nt Targ: | 5'-CCAUGGAGGGCGCCGGCGGCG-3' | (SEQ ID NO: 1659) |
| HIF-1α-448 21 nt Targ: | 5'-CGCGAACGACAAGAAAAAGAU-3' | (SEQ ID NO: 1660) |
| HIF-1α-455 21 nt Targ: | 5'-GACAAGAAAAGAUAAGUUCU-3' | (SEQ ID NO: 1661) |
| HIF-1α-469 21 nt Targ: | 5'-AAGUUCUGAACGUCGAAAAGA-3' | (SEQ ID NO: 1662) |
| HIF-1α-471 21 nt Targ: | 5'-GUUCUGAACGUCGAAAAGAAA-3' | (SEQ ID NO: 1663) |
| HIF-1α-473 21 nt Targ: | 5'-UCUGAACGUCGAAAAGAAAAG-3' | (SEQ ID NO: 1664) |
| HIF-1α-475 21 nt Targ: | 5'-UGAACGUCGAAAAGAAAAGUC-3' | (SEQ ID NO: 1665) |
| HIF-1α-525 21 nt Targ: | 5'-AAGAAUCUGAAGUUUUUAUG-3' | (SEQ ID NO: 1666) |
| HIF-1α-528 21 nt Targ: | 5'-AAUCUGAAGUUUUUAUGAGC-3' | (SEQ ID NO: 1667) |
| HIF-1α-530 21 nt Targ: | 5'-UCUGAAGUUUUUAUGAGCUU-3' | (SEQ ID NO: 1668) |
| HIF-1α-532 21 nt Targ: | 5'-UGAAGUUUUUAUGAGCUUGC-3' | (SEQ ID NO: 1669) |
| HIF-1α-534 21 nt Targ: | 5'-AAGUUUUUAUGAGCUUGCUC-3' | (SEQ ID NO: 1670) |
| HIF-1α-536 21 nt Targ: | 5'-GUUUUUAUGAGCUUGCUCAU-3' | (SEQ ID NO: 1671) |
| HIF-1α-538 21 nt Targ: | 5'-UUUUUAUGAGCUUGCUCAUCA-3' | (SEQ ID NO: 1672) |
| HIF-1α-540 21 nt Targ: | 5'-UUUAUGAGCUUGCUCAUCAGU-3' | (SEQ ID NO: 1673) |

TABLE 5-continued

DsiRNA Target Sequences (21mers) In HIF-1α mRNA

| | | |
|---|---|---|
| HIF-1α-542 21 nt Targ: | 5'-UAUGAGCUUGCUCAUCAGUUG-3' | (SEQ ID NO: 1674) |
| HIF-1α-544 21 nt Targ: | 5'-UGAGCUUGCUCAUCAGUUGCC-3' | (SEQ ID NO: 1675) |
| HIF-1α-546 21 nt Targ: | 5'-AGCUUGCUCAUCAGUUGCCAC-3' | (SEQ ID NO: 1676) |
| HIF-1α-548 21 nt Targ: | 5'-CUUGCUCAUCAGUUGCCACUU-3' | (SEQ ID NO: 1677) |
| HIF-1α-550 21 nt Targ: | 5'-UGCUCAUCAGUUGCCACUUCC-3' | (SEQ ID NO: 1678) |
| HIF-1α-562 21 nt Targ: | 5'-GCCACUUCCACAUAAUGUGAG-3' | (SEQ ID NO: 1679) |
| HIF-1α-642 21 nt Targ: | 5'-AACUUCUGGAUGCUGGUGAUU-3' | (SEQ ID NO: 1680) |
| HIF-1α-644 21 nt Targ: | 5'-CUUCUGGAUGCUGGUGAUUUG-3' | (SEQ ID NO: 1681) |
| HIF-1α-645 21 nt Targ: | 5'-UUCUGGAUGCUGGUGAUUUGG-3' | (SEQ ID NO: 1682) |
| HIF-1α-665 21 nt Targ: | 5'-GAUAUUGAAGAUGACAUGAAA-3' | (SEQ ID NO: 1683) |
| HIF-1α-691 21 nt Targ: | 5'-GAUGAAUUGCUUUUAUUUGAA-3' | (SEQ ID NO: 1684) |
| HIF-1α-707 21 nt Targ: | 5'-UUGAAAGCCUUGGAUGGUUUU-3' | (SEQ ID NO: 1685) |
| HIF-1α-711 21 nt Targ: | 5'-AAGCCUUGGAUGGUUUUGUUA-3' | (SEQ ID NO: 1686) |
| HIF-1α-713 21 nt Targ: | 5'-GCCUUGGAUGGUUUUGUUAUG-3' | (SEQ ID NO: 1687) |
| HIF-1α-715 21 nt Targ: | 5'-CUUGGAUGGUUUUGUUAUGGU-3' | (SEQ ID NO: 1688) |
| HIF-1α-717 21 nt Targ: | 5'-UGGAUGGUUUUGUUAUGGUUC-3' | (SEQ ID NO: 1689) |
| HIF-1α-756 21 nt Targ: | 5'-UGAUUUACAUUUCUGAUAAUG-3' | (SEQ ID NO: 1690) |
| HIF-1α-790 21 nt Targ: | 5'-GGGAUUAACUCAGUUUGAACU-3' | (SEQ ID NO: 1691) |
| HIF-1α-793 21 nt Targ: | 5'-AUUAACUCAGUUUGAACUAAC-3' | (SEQ ID NO: 1692) |
| HIF-1α-824 21 nt Targ: | 5'-GUGUUUGAUUUACUCAUCCA-3' | (SEQ ID NO: 1693) |
| HIF-1α-826 21 nt Targ: | 5'-GUUUGAUUUACUCAUCCAUG-3' | (SEQ ID NO: 1694) |
| HIF-1α-828 21 nt Targ: | 5'-UUGAUUUACUCAUCCAUGUG-3' | (SEQ ID NO: 1695) |
| HIF-1α-830 21 nt Targ: | 5'-GAUUUACUCAUCCAUGUGAC-3' | (SEQ ID NO: 1696) |
| HIF-1α-832 21 nt Targ: | 5'-UUUUACUCAUCCAUGUGACCA-3' | (SEQ ID NO: 1697) |
| HIF-1α-834 21 nt Targ: | 5'-UUACUCAUCCAUGUGACCAUG-3' | (SEQ ID NO: 1698) |
| HIF-1α-836 21 nt Targ: | 5'-ACUCAUCCAUGUGACCAUGAG-3' | (SEQ ID NO: 1699) |
| HIF-1α-838 21 nt Targ: | 5'-UCAUCCAUGUGACCAUGAGGA-3' | (SEQ ID NO: 1700) |
| HIF-1α-840 21 nt Targ: | 5'-AUCCAUGUGACCAUGAGGAAA-3' | (SEQ ID NO: 1701) |
| HIF-1α-842 21 nt Targ: | 5'-CCAUGUGACCAUGAGGAAAUG-3' | (SEQ ID NO: 1702) |
| HIF-1α-844 21 nt Targ: | 5'-AUGUGACCAUGAGGAAAUGAG-3' | (SEQ ID NO: 1703) |
| HIF-1α-846 21 nt Targ: | 5'-GUGACCAUGAGGAAAUGAGAG-3' | (SEQ ID NO: 1704) |
| HIF-1α-848 21 nt Targ: | 5'-GACCAUGAGGAAAUGAGAGAA-3' | (SEQ ID NO: 1705) |
| HIF-1α-850 21 nt Targ: | 5'-CCAUGAGGAAAUGAGAGAAAU-3' | (SEQ ID NO: 1706) |
| HIF-1α-852 21 nt Targ: | 5'-AUGAGGAAAUGAGAGAAAUGC-3' | (SEQ ID NO: 1707) |
| HIF-1α-921 21 nt Targ: | 5'-AGCGAAGCUUUUUCUCAGAA-3' | (SEQ ID NO: 1708) |
| HIF-1α-925 21 nt Targ: | 5'-AAGCUUUUUCUCAGAAUGAA-3' | (SEQ ID NO: 1709) |
| HIF-1α-927 21 nt Targ: | 5'-GCUUUUUCUCAGAAUGAAGU-3' | (SEQ ID NO: 1710) |
| HIF-1α-1029 21 nt Targ: | 5'-UAUAUGAUACCAACAGUAACC-3' | (SEQ ID NO: 1711) |
| HIF-1α-1031 21 nt Targ: | 5'-UAUGAUACCAACAGUAACCAA-3' | (SEQ ID NO: 1712) |

TABLE 5-continued

DsiRNA Target Sequences (21mers) In HIF-1α mRNA

| | | | |
|---|---|---|---|
| HIF-1α-1033 21 nt Targ: | 5'-UGAUACCAACAGUAACCAACC-3' | (SEQ ID NO: 1713) |
| HIF-1α-1035 21 nt Targ: | 5'-AUACCAACAGUAACCAACCUC-3' | (SEQ ID NO: 1714) |
| HIF-1α-1037 21 nt Targ: | 5'-ACCAACAGUAACCAACCUCAG-3' | (SEQ ID NO: 1715) |
| HIF-1α-1039 21 nt Targ: | 5'-CAACAGUAACCAACCUCAGUG-3' | (SEQ ID NO: 1716) |
| HIF-1α-1041 21 nt Targ: | 5'-ACAGUAACCAACCUCAGUGUG-3' | (SEQ ID NO: 1717) |
| HIF-1α-1043 21 nt Targ: | 5'-AGUAACCAACCUCAGUGUGGG-3' | (SEQ ID NO: 1718) |
| HIF-1α-1045 21 nt Targ: | 5'-UAACCAACCUCAGUGUGGGUA-3' | (SEQ ID NO: 1719) |
| HIF-1α-1074 21 nt Targ: | 5'-CACCUAUGACCUGCUUGGUGC-3' | (SEQ ID NO: 1720) |
| HIF-1α-1075 21 nt Targ: | 5'-ACCUAUGACCUGCUUGGUGCU-3' | (SEQ ID NO: 1721) |
| HIF-1α-1077 21 nt Targ: | 5'-CUAUGACCUGCUUGGUGCUGA-3' | (SEQ ID NO: 1722) |
| HIF-1α-1084 21 nt Targ: | 5'-CUGCUUGGUGCUGAUUUGUGA-3' | (SEQ ID NO: 1723) |
| HIF-1α-1086 21 nt Targ: | 5'-GCUUGGUGCUGAUUUGUGAAC-3' | (SEQ ID NO: 1724) |
| HIF-1α-1088 21 nt Targ: | 5'-UUGGUGCUGAUUUGUGAACCC-3' | (SEQ ID NO: 1725) |
| HIF-1α-1090 21 nt Targ: | 5'-GGUGCUGAUUUGUGAACCCAU-3' | (SEQ ID NO: 1726) |
| HIF-1α-1092 21 nt Targ: | 5'-UGCUGAUUUGUGAACCCAUUC-3' | (SEQ ID NO: 1727) |
| HIF-1α-1094 21 nt Targ: | 5'-CUGAUUUGUGAACCCAUUCCU-3' | (SEQ ID NO: 1728) |
| HIF-1α-1096 21 nt Targ: | 5'-GAUUUGUGAACCCAUUCCUCA-3' | (SEQ ID NO: 1729) |
| HIF-1α-1120 21 nt Targ: | 5'-AUCAAAUAUUGAAAUUCCUUU-3' | (SEQ ID NO: 1730) |
| HIF-1α-1122 21 nt Targ: | 5'-CAAAUAUUGAAAUUCCUUUAG-3' | (SEQ ID NO: 1731) |
| HIF-1α-1124 21 nt Targ: | 5'-AAUAUUGAAAUUCCUUUAGAU-3' | (SEQ ID NO: 1732) |
| HIF-1α-1126 21 nt Targ: | 5'-UAUUGAAAUUCCUUUAGAUAG-3' | (SEQ ID NO: 1733) |
| HIF-1α-1128 21 nt Targ: | 5'-UUGAAAUUCCUUUAGAUAGCA-3' | (SEQ ID NO: 1734) |
| HIF-1α-1130 21 nt Targ: | 5'-GAAAUUCCUUUAGAUAGCAAG-3' | (SEQ ID NO: 1735) |
| HIF-1α-1132 21 nt Targ: | 5'-AAUUCCUUUAGAUAGCAAGAC-3' | (SEQ ID NO: 1736) |
| HIF-1α-1166 21 nt Targ: | 5'-CACAGCCUGGAUAUGAAAUUU-3' | (SEQ ID NO: 1737) |
| HIF-1α-1174 21 nt Targ: | 5'-GGAUAUGAAAUUUCUUAUUG-3' | (SEQ ID NO: 1738) |
| HIF-1α-1243 21 nt Targ: | 5'-AGGCCGCUCAAUUUAUGAAUA-3' | (SEQ ID NO: 1739) |
| HIF-1α-1245 21 nt Targ: | 5'-GCCGCUCAAUUUAUGAAUAUU-3' | (SEQ ID NO: 1740) |
| HIF-1α-1247 21 nt Targ: | 5'-CGCUCAAUUUAUGAAUAUUAU-3' | (SEQ ID NO: 1741) |
| HIF-1α-1249 21 nt Targ: | 5'-CUCAAUUUAUGAAUAUUAUCA-3' | (SEQ ID NO: 1742) |
| HIF-1α-1251 21 nt Targ: | 5'-CAAUUUAUGAAUAUUAUCAUG-3' | (SEQ ID NO: 1743) |
| HIF-1α-1253 21 nt Targ: | 5'-AUUUAUGAAUAUUAUCAUGCU-3' | (SEQ ID NO: 1744) |
| HIF-1α-1255 21 nt Targ: | 5'-UUAUGAAUAUUAUCAUGCUUU-3' | (SEQ ID NO: 1745) |
| HIF-1α-1257 21 nt Targ: | 5'-AUGAAUAUUAUCAUGCUUUGG-3' | (SEQ ID NO: 1746) |
| HIF-1α-1262 21 nt Targ: | 5'-UAUUAUCAUGCUUUGGACUCU-3' | (SEQ ID NO: 1747) |
| HIF-1α-1265 21 nt Targ: | 5'-UAUCAUGCUUUGGACUCUGAU-3' | (SEQ ID NO: 1748) |
| HIF-1α-1268 21 nt Targ: | 5'-CAUGCUUUGGACUCUGAUCAU-3' | (SEQ ID NO: 1749) |
| HIF-1α-1271 21 nt Targ: | 5'-GCUUUGGACUCUGAUCAUCUG-3' | (SEQ ID NO: 1750) |
| HIF-1α-1278 21 nt Targ: | 5'-ACUCUGAUCAUCUGACCAAAA-3' | (SEQ ID NO: 1751) |

TABLE 5-continued

DsiRNA Target Sequences (21mers) In HIF-1α mRNA

| | | |
|---|---|---|
| HIF-1α-1280 21 nt Targ: | 5'-UCUGAUCAUCUGACCAAAACU-3' | (SEQ ID NO: 1752) |
| HIF-1α-1282 21 nt Targ: | 5'-UGAUCAUCUGACCAAAACUCA-3' | (SEQ ID NO: 1753) |
| HIF-1α-1303 21 nt Targ: | 5'-UCAUGAUAUGUUUACUAAAGG-3' | (SEQ ID NO: 1754) |
| HIF-1α-1305 21 nt Targ: | 5'-AUGAUAUGUUUACUAAAGGAC-3' | (SEQ ID NO: 1755) |
| HIF-1α-1307 21 nt Targ: | 5'-GAUAUGUUUACUAAAGGACAA-3' | (SEQ ID NO: 1756) |
| HIF-1α-1309 21 nt Targ: | 5'-UAUGUUUACUAAAGGACAAGU-3' | (SEQ ID NO: 1757) |
| HIF-1α-1311 21 nt Targ: | 5'-UGUUUACUAAAGGACAAGUCA-3' | (SEQ ID NO: 1758) |
| HIF-1α-1313 21 nt Targ: | 5'-UUUACUAAAGGACAAGUCACC-3' | (SEQ ID NO: 1759) |
| HIF-1α-1315 21 nt Targ: | 5'-UACUAAAGGACAAGUCACCAC-3' | (SEQ ID NO: 1760) |
| HIF-1α-1317 21 nt Targ: | 5'-CUAAAGGACAAGUCACCACAG-3' | (SEQ ID NO: 1761) |
| HIF-1α-1319 21 nt Targ: | 5'-AAAGGACAAGUCACCACAGGA-3' | (SEQ ID NO: 1762) |
| HIF-1α-1321 21 nt Targ: | 5'-AGGACAAGUCACCACAGGACA-3' | (SEQ ID NO: 1763) |
| HIF-1α-1323 21 nt Targ: | 5'-GACAAGUCACCACAGGACAGU-3' | (SEQ ID NO: 1764) |
| HIF-1α-1325 21 nt Targ: | 5'-CAAGUCACCACAGGACAGUAC-3' | (SEQ ID NO: 1765) |
| HIF-1α-1327 21 nt Targ: | 5'-AGUCACCACAGGACAGUACAG-3' | (SEQ ID NO: 1766) |
| HIF-1α-1329 21 nt Targ: | 5'-UCACCACAGGACAGUACAGGA-3' | (SEQ ID NO: 1767) |
| HIF-1α-1331 21 nt Targ: | 5'-ACCACAGGACAGUACAGGAUG-3' | (SEQ ID NO: 1768) |
| HIF-1α-1333 21 nt Targ: | 5'-CACAGGACAGUACAGGAUGCU-3' | (SEQ ID NO: 1769) |
| HIF-1α-1335 21 nt Targ: | 5'-CAGGACAGUACAGGAUGCUUG-3' | (SEQ ID NO: 1770) |
| HIF-1α-1337 21 nt Targ: | 5'-GGACAGUACAGGAUGCUUGCC-3' | (SEQ ID NO: 1771) |
| HIF-1α-1339 21 nt Targ: | 5'-ACAGUACAGGAUGCUUGCCAA-3' | (SEQ ID NO: 1772) |
| HIF-1α-1341 21 nt Targ: | 5'-AGUACAGGAUGCUUGCCAAAA-3' | (SEQ ID NO: 1773) |
| HIF-1α-1343 21 nt Targ: | 5'-UACAGGAUGCUUGCCAAAAGA-3' | (SEQ ID NO: 1774) |
| HIF-1α-1345 21 nt Targ: | 5'-CAGGAUGCUUGCCAAAAGAGG-3' | (SEQ ID NO: 1775) |
| HIF-1α-1347 21 nt Targ: | 5'-GGAUGCUUGCCAAAAGAGGUG-3' | (SEQ ID NO: 1776) |
| HIF-1α-1349 21 nt Targ: | 5'-AUGCUUGCCAAAAGAGGUGGA-3' | (SEQ ID NO: 1777) |
| HIF-1α-1351 21 nt Targ: | 5'-GCUUGCCAAAAGAGGUGGAUA-3' | (SEQ ID NO: 1778) |
| HIF-1α-1353 21 nt Targ: | 5'-UUGCCAAAAGAGGUGGAUAUG-3' | (SEQ ID NO: 1779) |
| HIF-1α-1355 21 nt Targ: | 5'-GCCAAAAGAGGUGGAUAUGUC-3' | (SEQ ID NO: 1780) |
| HIF-1α-1357 21 nt Targ: | 5'-CAAAAGAGGUGGAUAUGUCUG-3' | (SEQ ID NO: 1781) |
| HIF-1α-1359 21 nt Targ: | 5'-AAAGAGGUGGAUAUGUCUGGG-3' | (SEQ ID NO: 1782) |
| HIF-1α-1361 21 nt Targ: | 5'-AGAGGUGGAUAUGUCUGGGUU-3' | (SEQ ID NO: 1783) |
| HIF-1α-1363 21 nt Targ: | 5'-AGGUGGAUAUGUCUGGGUUGA-3' | (SEQ ID NO: 1784) |
| HIF-1α-1365 21 nt Targ: | 5'-GUGGAUAUGUCUGGGUUGAAA-3' | (SEQ ID NO: 1785) |
| HIF-1α-1367 21 nt Targ: | 5'-GGAUAUGUCUGGGUUGAAACU-3' | (SEQ ID NO: 1786) |
| HIF-1α-1369 21 nt Targ: | 5'-AUAUGUCUGGGUUGAAACUCA-3' | (SEQ ID NO: 1787) |
| HIF-1α-1371 21 nt Targ: | 5'-AUGUCUGGGUUGAAACUCAAG-3' | (SEQ ID NO: 1788) |
| HIF-1α-1373 21 nt Targ: | 5'-GUCUGGGUUGAAACUCAAGCA-3' | (SEQ ID NO: 1789) |
| HIF-1α-1375 21 nt Targ: | 5'-CUGGGUUGAAACUCAAGCAAC-3' | (SEQ ID NO: 1790) |

TABLE 5-continued

DsiRNA Target Sequences (21mers) In HIF-1α mRNA

| | | | |
|---|---|---|---|
| HIF-1α-1377 21 nt Targ: | 5'-GGGUUGAAACUCAAGCAACUG-3' | (SEQ ID NO: 1791) |
| HIF-1α-1379 21 nt Targ: | 5'-GUUGAAACUCAAGCAACUGUC-3' | (SEQ ID NO: 1792) |
| HIF-1α-1381 21 nt Targ: | 5'-UGAAACUCAAGCAACUGUCAU-3' | (SEQ ID NO: 1793) |
| HIF-1α-1383 21 nt Targ: | 5'-AAACUCAAGCAACUGUCAUAU-3' | (SEQ ID NO: 1794) |
| HIF-1α-1385 21 nt Targ: | 5'-ACUCAAGCAACUGUCAUAUAU-3' | (SEQ ID NO: 1795) |
| HIF-1α-1387 21 nt Targ: | 5'-UCAAGCAACUGUCAUAUAUAA-3' | (SEQ ID NO: 1796) |
| HIF-1α-1456 21 nt Targ: | 5'-GAGUGGUAUUAUUCAGCACGA-3' | (SEQ ID NO: 1797) |
| HIF-1α-1458 21 nt Targ: | 5'-GUGGUAUUAUUCAGCACGACU-3' | (SEQ ID NO: 1798) |
| HIF-1α-1460 21 nt Targ: | 5'-GGUAUUAUUCAGCACGACUUG-3' | (SEQ ID NO: 1799) |
| HIF-1α-1462 21 nt Targ: | 5'-UAUUAUUCAGCACGACUUGAU-3' | (SEQ ID NO: 1800) |
| HIF-1α-1464 21 nt Targ: | 5'-UUAUUCAGCACGACUUGAUUU-3' | (SEQ ID NO: 1801) |
| HIF-1α-1466 21 nt Targ: | 5'-AUUCAGCACGACUUGAUUUUC-3' | (SEQ ID NO: 1802) |
| HIF-1α-1468 21 nt Targ: | 5'-UCAGCACGACUUGAUUUUCUC-3' | (SEQ ID NO: 1803) |
| HIF-1α-1470 21 nt Targ: | 5'-AGCACGACUUGAUUUUCUCCC-3' | (SEQ ID NO: 1804) |
| HIF-1α-1472 21 nt Targ: | 5'-CACGACUUGAUUUUCUCCCUU-3' | (SEQ ID NO: 1805) |
| HIF-1α-1474 21 nt Targ: | 5'-CGACUUGAUUUUCUCCCUUCA-3' | (SEQ ID NO: 1806) |
| HIF-1α-1476 21 nt Targ: | 5'-ACUUGAUUUUCUCCCUUCAAC-3' | (SEQ ID NO: 1807) |
| HIF-1α-1478 21 nt Targ: | 5'-UUGAUUUUCUCCCUUCAACAA-3' | (SEQ ID NO: 1808) |
| HIF-1α-1480 21 nt Targ: | 5'-GAUUUUCUCCCUUCAACAAAC-3' | (SEQ ID NO: 1809) |
| HIF-1α-1482 21 nt Targ: | 5'-UUUUCUCCCUUCAACAAACAG-3' | (SEQ ID NO: 1810) |
| HIF-1α-1519 21 nt Targ: | 5'-GGUUGAAUCUUCAGAUAUGAA-3' | (SEQ ID NO: 1811) |
| HIF-1α-1552 21 nt Targ: | 5'-AUUCACCAAAGUUGAAUCAGA-3' | (SEQ ID NO: 1812) |
| HIF-1α-1572 21 nt Targ: | 5'-AAGAUACAAGUAGCCUCUUUG-3' | (SEQ ID NO: 1813) |
| HIF-1α-1648 21 nt Targ: | 5'-CACAAUCAUAUCUUUAGAUUU-3' | (SEQ ID NO: 1814) |
| HIF-1α-1709 21 nt Targ: | 5'-GAAGUACCAUUAUAUAAUGAU-3' | (SEQ ID NO: 1815) |
| HIF-1α-1714 21 nt Targ: | 5'-ACCAUUAUAUAAUGAUGUAAU-3' | (SEQ ID NO: 1816) |
| HIF-1α-1786 21 nt Targ: | 5'-AUUACCCACCGCUGAAACGCC-3' | (SEQ ID NO: 1817) |
| HIF-1α-1804 21 nt Targ: | 5'-GCCAAAGCCACUUCGAAGUAG-3' | (SEQ ID NO: 1818) |
| HIF-1α-1806 21 nt Targ: | 5'-CAAAGCCACUUCGAAGUAGUG-3' | (SEQ ID NO: 1819) |
| HIF-1α-1808 21 nt Targ: | 5'-AAGCCACUUCGAAGUAGUGCU-3' | (SEQ ID NO: 1820) |
| HIF-1α-1810 21 nt Targ: | 5'-GCCACUUCGAAGUAGUGCUGA-3' | (SEQ ID NO: 1821) |
| HIF-1α-1814 21 nt Targ: | 5'-CUUCGAAGUAGUGCUGACCCU-3' | (SEQ ID NO: 1822) |
| HIF-1α-1845 21 nt Targ: | 5'-AAGAAGUUGCAUUAAAAUUAG-3' | (SEQ ID NO: 1823) |
| HIF-1α-1936 21 nt Targ: | 5'-CGAUGGAAGCACUAGACAAAG-3' | (SEQ ID NO: 1824) |
| HIF-1α-1938 21 nt Targ: | 5'-AUGGAAGCACUAGACAAAGUU-3' | (SEQ ID NO: 1825) |
| HIF-1α-1940 21 nt Targ: | 5'-GGAAGCACUAGACAAAGUUCA-3' | (SEQ ID NO: 1826) |
| HIF-1α-1942 21 nt Targ: | 5'-AAGCACUAGACAAAGUUCACC-3' | (SEQ ID NO: 1827) |
| HIF-1α-1944 21 nt Targ: | 5'-GCACUAGACAAAGUUCACCUG-3' | (SEQ ID NO: 1828) |
| HIF-1α-1946 21 nt Targ: | 5'-ACUAGACAAAGUUCACCUGAG-3' | (SEQ ID NO: 1829) |

TABLE 5-continued

DsiRNA Target Sequences (21mers) In HIF-1α mRNA

| | | | |
|---|---|---|---|
| HIF-1α-1977 21 nt Targ: | 5'-CCAGUGAAUAUUGUUUUUAUG-3' | (SEQ ID NO: | 1830) |
| HIF-1α-1985 21 nt Targ: | 5'-UAUUGUUUUUAUGUGGAUAGU-3' | (SEQ ID NO: | 1831) |
| HIF-1α-2034 21 nt Targ: | 5'-UGGUAGAAAAACUUUUUGCUG-3' | (SEQ ID NO: | 1832) |
| HIF-1α-2116 21 nt Targ: | 5'-AGCUCCCUAUAUCCCAAUGGA-3' | (SEQ ID NO: | 1833) |
| HIF-1α-2118 21 nt Targ: | 5'-CUCCCUAUAUCCCAAUGGAUG-3' | (SEQ ID NO: | 1834) |
| HIF-1α-2120 21 nt Targ: | 5'-CCCUAUAUCCCAAUGGAUGAU-3' | (SEQ ID NO: | 1835) |
| HIF-1α-2122 21 nt Targ: | 5'-CUAUAUCCCAAUGGAUGAUGA-3' | (SEQ ID NO: | 1836) |
| HIF-1α-2161 21 nt Targ: | 5'-CGAUCAGUUGUCACCAUUAGA-3' | (SEQ ID NO: | 1837) |
| HIF-1α-2185 21 nt Targ: | 5'-CAGUUCCGCAAGCCCUGAAAG-3' | (SEQ ID NO: | 1838) |
| HIF-1α-2187 21 nt Targ: | 5'-GUUCCGCAAGCCCUGAAAGCG-3' | (SEQ ID NO: | 1839) |
| HIF-1α-2290 21 nt Targ: | 5'-CACUGAUGAAUUAAAAACAGU-3' | (SEQ ID NO: | 1840) |
| HIF-1α-2326 21 nt Targ: | 5'-GGAAGACAUUAAAAUAUUGAU-3' | (SEQ ID NO: | 1841) |
| HIF-1α-2452 21 nt Targ: | 5'-AGGAGUCAUAGAACAGACAGA-3' | (SEQ ID NO: | 1842) |
| HIF-1α-2555 21 nt Targ: | 5'-AAGAUACUAGCUUUGCAGAAU-3' | (SEQ ID NO: | 1843) |
| HIF-1α-2577 21 nt Targ: | 5'-CUCAGAGAAAGCGAAAAAUGG-3' | (SEQ ID NO: | 1844) |
| HIF-1α-2584 21 nt Targ: | 5'-AAAGCGAAAAAUGGAACAUGA-3' | (SEQ ID NO: | 1845) |
| HIF-1α-2586 21 nt Targ: | 5'-AGCGAAAAAUGGAACAUGAUG-3' | (SEQ ID NO: | 1846) |
| HIF-1α-2618 21 nt Targ: | 5'-CAAGCAGUAGGAAUUGGAACA-3' | (SEQ ID NO: | 1847) |
| HIF-1α-2705 21 nt Targ: | 5'-AAAUCUAGUGAACAGAAUGGA-3' | (SEQ ID NO: | 1848) |
| HIF-1α-2730 21 nt Targ: | 5'-AGCAAAAGACAAUUAUUUUAA-3' | (SEQ ID NO: | 1849) |
| HIF-1α-2796 21 nt Targ: | 5'-AAAGUGGAUUACCACAGCUGA-3' | (SEQ ID NO: | 1850) |
| HIF-1α-2798 21 nt Targ: | 5'-AGUGGAUUACCACAGCUGACC-3' | (SEQ ID NO: | 1851) |
| HIF-1α-2800 21 nt Targ: | 5'-UGGAUUACCACAGCUGACCAG-3' | (SEQ ID NO: | 1852) |
| HIF-1α-2802 21 nt Targ: | 5'-GAUUACCACAGCUGACCAGUU-3' | (SEQ ID NO: | 1853) |
| HIF-1α-2823 21 nt Targ: | 5'-AUGAUUGUGAAGUUAAUGCUC-3' | (SEQ ID NO: | 1854) |
| HIF-1α-2844 21 nt Targ: | 5'-CUAUACAAGGCAGCAGAAACC-3' | (SEQ ID NO: | 1855) |
| HIF-1α-2846 21 nt Targ: | 5'-AUACAAGGCAGCAGAAACCUA-3' | (SEQ ID NO: | 1856) |
| HIF-1α-2848 21 nt Targ: | 5'-ACAAGGCAGCAGAAACCUACU-3' | (SEQ ID NO: | 1857) |
| HIF-1α-2850 21 nt Targ: | 5'-AAGGCAGCAGAAACCUACUGC-3' | (SEQ ID NO: | 1858) |
| HIF-1α-2852 21 nt Targ: | 5'-GGCAGCAGAAACCUACUGCAG-3' | (SEQ ID NO: | 1859) |
| HIF-1α-2854 21 nt Targ: | 5'-CAGCAGAAACCUACUGCAGGG-3' | (SEQ ID NO: | 1860) |
| HIF-1α-2856 21 nt Targ: | 5'-GCAGAAACCUACUGCAGGGUG-3' | (SEQ ID NO: | 1861) |
| HIF-1α-2858 21 nt Targ: | 5'-AGAAACCUACUGCAGGGUGAA-3' | (SEQ ID NO: | 1862) |
| HIF-1α-2860 21 nt Targ: | 5'-AAACCUACUGCAGGGUGAAGA-3' | (SEQ ID NO: | 1863) |
| HIF-1α-2862 21 nt Targ: | 5'-ACCUACUGCAGGGUGAAGAAU-3' | (SEQ ID NO: | 1864) |
| HIF-1α-2864 21 nt Targ: | 5'-CUACUGCAGGGUGAAGAAUUA-3' | (SEQ ID NO: | 1865) |
| HIF-1α-2866 21 nt Targ: | 5'-ACUGCAGGGUGAAGAAUUACU-3' | (SEQ ID NO: | 1866) |
| HIF-1α-2868 21 nt Targ: | 5'-UGCAGGGUGAAGAAUUACUCA-3' | (SEQ ID NO: | 1867) |
| HIF-1α-2870 21 nt Targ: | 5'-CAGGGUGAAGAAUUACUCAGA-3' | (SEQ ID NO: | 1868) |

TABLE 5-continued

DsiRNA Target Sequences (21mers) In HIF-1α mRNA

| | | | |
|---|---|---|---|
| HIF-1α-2872 21 nt Targ: | 5'-GGGUGAAGAAUUACUCAGAGC-3' | (SEQ ID NO: 1869) |
| HIF-1α-2874 21 nt Targ: | 5'-GUGAAGAAUUACUCAGAGCUU-3' | (SEQ ID NO: 1870) |
| HIF-1α-2876 21 nt Targ: | 5'-GAAGAAUUACUCAGAGCUUUG-3' | (SEQ ID NO: 1871) |
| HIF-1α-2878 21 nt Targ: | 5'-AGAAUUACUCAGAGCUUUGGA-3' | (SEQ ID NO: 1872) |
| HIF-1α-2880 21 nt Targ: | 5'-AAUUACUCAGAGCUUUGGAUC-3' | (SEQ ID NO: 1873) |
| HIF-1α-2882 21 nt Targ: | 5'-UUACUCAGAGCUUUGGAUCAA-3' | (SEQ ID NO: 1874) |
| HIF-1α-2884 21 nt Targ: | 5'-ACUCAGAGCUUUGGAUCAAGU-3' | (SEQ ID NO: 1875) |
| HIF-1α-2886 21 nt Targ: | 5'-UCAGAGCUUUGGAUCAAGUUA-3' | (SEQ ID NO: 1876) |
| HIF-1α-2888 21 nt Targ: | 5'-AGAGCUUUGGAUCAAGUUAAC-3' | (SEQ ID NO: 1877) |
| HIF-1α-2890 21 nt Targ: | 5'-AGCUUUGGAUCAAGUUAACUG-3' | (SEQ ID NO: 1878) |
| HIF-1α-2892 21 nt Targ: | 5'-CUUUGGAUCAAGUUAACUGAG-3' | (SEQ ID NO: 1879) |
| HIF-1α-2895 21 nt Targ: | 5'-UGGAUCAAGUUAACUGAGCUU-3' | (SEQ ID NO: 1880) |
| HIF-1α-2906 21 nt Targ: | 5'-AACUGAGCUUUUUCUUAAUUU-3' | (SEQ ID NO: 1881) |
| HIF-1α-2910 21 nt Targ: | 5'-GAGCUUUUUCUUAAUUUCAUU-3' | (SEQ ID NO: 1882) |
| HIF-1α-2919 21 nt Targ: | 5'-CUUAAUUUCAUUCCUUUUUUU-3' | (SEQ ID NO: 1883) |
| HIF-1α-2925 21 nt Targ: | 5'-UUCAUUCCUUUUUUUGGACAC-3' | (SEQ ID NO: 1884) |
| HIF-1α-2933 21 nt Targ: | 5'-UUUUUUUGGACACUGGUGGCU-3' | (SEQ ID NO: 1885) |
| HIF-1α-2935 21 nt Targ: | 5'-UUUUUGGACACUGGUGGCUCA-3' | (SEQ ID NO: 1886) |
| HIF-1α-2963 21 nt Targ: | 5'-AAGCAGUCUAUUUAUAUUUUC-3' | (SEQ ID NO: 1887) |
| HIF-1α-2965 21 nt Targ: | 5'-GCAGUCUAUUUAUAUUUUCUA-3' | (SEQ ID NO: 1888) |
| HIF-1α-2970 21 nt Targ: | 5'-CUAUUUAUAUUUUCUACAUCU-3' | (SEQ ID NO: 1889) |
| HIF-1α-2986 21 nt Targ: | 5'-CAUCUAAUUUUAGAAGCCUGG-3' | (SEQ ID NO: 1890) |
| HIF-1α-2988 21 nt Targ: | 5'-UCUAAUUUUAGAAGCCUGGCU-3' | (SEQ ID NO: 1891) |
| HIF-1α-2990 21 nt Targ: | 5'-UAAUUUUAGAAGCCUGGCUAC-3' | (SEQ ID NO: 1892) |
| HIF-1α-2992 21 nt Targ: | 5'-AUUUUAGAAGCCUGGCUACAA-3' | (SEQ ID NO: 1893) |
| HIF-1α-2994 21 nt Targ: | 5'-UUUAGAAGCCUGGCUACAAUA-3' | (SEQ ID NO: 1894) |
| HIF-1α-2996 21 nt Targ: | 5'-UAGAAGCCUGGCUACAAUACU-3' | (SEQ ID NO: 1895) |
| HIF-1α-2998 21 nt Targ: | 5'-GAAGCCUGGCUACAAUACUGC-3' | (SEQ ID NO: 1896) |
| HIF-1α-3000 21 nt Targ: | 5'-AGCCUGGCUACAAUACUGCAC-3' | (SEQ ID NO: 1897) |
| HIF-1α-3002 21 nt Targ: | 5'-CCUGGCUACAAUACUGCACAA-3' | (SEQ ID NO: 1898) |
| HIF-1α-3004 21 nt Targ: | 5'-UGGCUACAAUACUGCACAAAC-3' | (SEQ ID NO: 1899) |
| HIF-1α-3055 21 nt Targ: | 5'-CUUAAUUUACAUUAAUGCUCU-3' | (SEQ ID NO: 1900) |
| HIF-1α-3065 21 nt Targ: | 5'-AUUAAUGCUCUUUUUUAGUAU-3' | (SEQ ID NO: 1901) |
| HIF-1α-3067 21 nt Targ: | 5'-UAAUGCUCUUUUUUAGUAUGU-3' | (SEQ ID NO: 1902) |
| HIF-1α-3068 21 nt Targ: | 5'-AAUGCUCUUUUUUAGUAUGUU-3' | (SEQ ID NO: 1903) |
| HIF-1α-3077 21 nt Targ: | 5'-UUUUAGUAUGUUCUUUAAUGC-3' | (SEQ ID NO: 1904) |
| HIF-1α-3081 21 nt Targ: | 5'-AGUAUGUUCUUUAAUGCUGGA-3' | (SEQ ID NO: 1905) |
| HIF-1α-3088 21 nt Targ: | 5'-UCUUUAAUGCUGGAUCACAGA-3' | (SEQ ID NO: 1906) |
| HIF-1α-3093 21 nt Targ: | 5'-AAUGCUGGAUCACAGACAGCU-3' | (SEQ ID NO: 1907) |

TABLE 5-continued

DsiRNA Target Sequences (21mers) In HIF-1α mRNA

| | | |
|---|---|---|
| HIF-1α-3110 21 nt Targ: | 5'-AGCUCAUUUCUCAGUUUUUU-3' | (SEQ ID NO: 1908) |
| HIF-1α-3167 21 nt Targ: | 5'-AAAAAAUGCACCUUUUUAUUU-3' | (SEQ ID NO: 1909) |
| HIF-1α-3169 21 nt Targ: | 5'-AAAAUGCACCUUUUUAUUUAU-3' | (SEQ ID NO: 1910) |
| HIF-1α-3171 21 nt Targ: | 5'-AAUGCACCUUUUUAUUUAUUU-3' | (SEQ ID NO: 1911) |
| HIF-1α-3173 21 nt Targ: | 5'-UGCACCUUUUUAUUUAUUUAU-3' | (SEQ ID NO: 1912) |
| HIF-1α-3175 21 nt Targ: | 5'-CACCUUUUUAUUUAUUUAUUU-3' | (SEQ ID NO: 1913) |
| HIF-1α-3177 21 nt Targ: | 5'-CCUUUUUAUUUAUUUAUUUUU-3' | (SEQ ID NO: 1914) |
| HIF-1α-3179 21 nt Targ: | 5'-UUUUUAUUUAUUUAUUUUUGG-3' | (SEQ ID NO: 1915) |
| HIF-1α-3215 21 nt Targ: | 5'-CUUUUUCGAAUUAUUUUUAAG-3' | (SEQ ID NO: 1916) |
| HIF-1α-3241 21 nt Targ: | 5'-GCCAAUAUAAUUUUUGUAAGA-3' | (SEQ ID NO: 1917) |
| HIF-1α-3274 21 nt Targ: | 5'-UUCAUCAUGAUCAUAGGCAGU-3' | (SEQ ID NO: 1918) |
| HIF-1α-3276 21 nt Targ: | 5'-CAUCAUGAUCAUAGGCAGUUG-3' | (SEQ ID NO: 1919) |
| HIF-1α-3278 21 nt Targ: | 5'-UCAUGAUCAUAGGCAGUUGAA-3' | (SEQ ID NO: 1920) |
| HIF-1α-3280 21 nt Targ: | 5'-AUGAUCAUAGGCAGUUGAAAA-3' | (SEQ ID NO: 1921) |
| HIF-1α-3292 21 nt Targ: | 5'-AGUUGAAAAAUUUUUACACCU-3' | (SEQ ID NO: 1922) |
| HIF-1α-3310 21 nt Targ: | 5'-CCUUUUUUUUCACAUUUUACA-3' | (SEQ ID NO: 1923) |
| HIF-1α-3358 21 nt Targ: | 5'-GUGGUAGCCACAAUUGCACAA-3' | (SEQ ID NO: 1924) |
| HIF-1α-3360 21 nt Targ: | 5'-GGUAGCCACAAUUGCACAAUA-3' | (SEQ ID NO: 1925) |
| HIF-1α-3362 21 nt Targ: | 5'-UAGCCACAAUUGCACAAUAUA-3' | (SEQ ID NO: 1926) |
| HIF-1α-3364 21 nt Targ: | 5'-GCCACAAUUGCACAAUAUAUU-3' | (SEQ ID NO: 1927) |
| HIF-1α-3366 21 nt Targ: | 5'-CACAAUUGCACAAUAUAUUUU-3' | (SEQ ID NO: 1928) |
| HIF-1α-3368 21 nt Targ: | 5'-CAAUUGCACAAUAUAUUUUCU-3' | (SEQ ID NO: 1929) |
| HIF-1α-3374 21 nt Targ: | 5'-CACAAUAUAUUUUCUUAAAAA-3' | (SEQ ID NO: 1930) |
| HIF-1α-3425 21 nt Targ: | 5'-GCGUUUAUAAAACUAGUUUUU-3' | (SEQ ID NO: 1931) |
| HIF-1α-3426 21 nt Targ: | 5'-CGUUUAUAAAACUAGUUUUUA-3' | (SEQ ID NO: 1932) |
| HIF-1α-3428 21 nt Targ: | 5'-UUUAUAAAACUAGUUUUUAAG-3' | (SEQ ID NO: 1933) |
| HIF-1α-3430 21 nt Targ: | 5'-UAUAAAACUAGUUUUUAAGAA-3' | (SEQ ID NO: 1934) |
| HIF-1α-3442 21 nt Targ: | 5'-UUUUAAGAAGAAAUUUUUUUU-3' | (SEQ ID NO: 1935) |
| HIF-1α-3448 21 nt Targ: | 5'-GAAGAAAUUUUUUUGGCCUA-3' | (SEQ ID NO: 1936) |
| HIF-1α-3450 21 nt Targ: | 5'-AGAAAUUUUUUUGGCCUAUG-3' | (SEQ ID NO: 1937) |
| HIF-1α-3465 21 nt Targ: | 5'-CCUAUGAAAUUGUUAAACCUG-3' | (SEQ ID NO: 1938) |
| HIF-1α-3493 21 nt Targ: | 5'-ACAUUGUUAAUCAUAUAAUAA-3' | (SEQ ID NO: 1939) |
| HIF-1α-3529 21 nt Targ: | 5'-GUAUGGUUUAUUAUUUAAAUG-3' | (SEQ ID NO: 1940) |
| HIF-1α-3546 21 nt Targ: | 5'-AAUGGGUAAAGCCAUUUACAU-3' | (SEQ ID NO: 1941) |
| HIF-1α-3557 21 nt Targ: | 5'-CCAUUUACAUAAUAUAGAAAG-3' | (SEQ ID NO: 1942) |
| HIF-1α-3592 21 nt Targ: | 5'-AGAAGGUAUGUGGCAUUUAUU-3' | (SEQ ID NO: 1943) |
| HIF-1α-3594 21 nt Targ: | 5'-AAGGUAUGUGGCAUUUAUUUG-3' | (SEQ ID NO: 1944) |
| HIF-1α-3596 21 nt Targ: | 5'-GGUAUGUGGCAUUUAUUUGGA-3' | (SEQ ID NO: 1945) |
| HIF-1α-3598 21 nt Targ: | 5'-UAUGUGGGCAUUUAUUUGGAUA-3' | (SEQ ID NO: 1946) |

TABLE 5-continued

DsiRNA Target Sequences (21mers) In HIF-1α mRNA

| | | | |
|---|---|---|---|
| HIF-1α-3600 21 nt Targ: | 5'-UGUGGCAUUUAUUUGGAUAAA-3' | (SEQ ID NO: 1947) |
| HIF-1α-3602 21 nt Targ: | 5'-UGGCAUUUAUUUGGAUAAAAU-3' | (SEQ ID NO: 1948) |
| HIF-1α-3604 21 nt Targ: | 5'-GCAUUUAUUUGGAUAAAAUUC-3' | (SEQ ID NO: 1949) |
| HIF-1α-3606 21 nt Targ: | 5'-AUUUAUUUGGAUAAAAUUCUC-3' | (SEQ ID NO: 1950) |
| HIF-1α-3608 21 nt Targ: | 5'-UUAUUUGGAUAAAAUUCUCAA-3' | (SEQ ID NO: 1951) |
| HIF-1α-3608 21 nt Targ: | 5'-UUAUUUGGAUAAAAUUCUCAA-3' | (SEQ ID NO: 1952) |
| HIF-1α-3610 21 nt Targ: | 5'-AUUUGGAUAAAAUUCUCAAUU-3' | (SEQ ID NO: 1953) |
| HIF-1α-3612 21 nt Targ: | 5'-UUGGAUAAAAUUCUCAAUUCA-3' | (SEQ ID NO: 1954) |
| HIF-1α-3614 21 nt Targ: | 5'-GGAUAAAAUUCUCAAUUCAGA-3' | (SEQ ID NO: 1955) |
| HIF-1α-3616 21 nt Targ: | 5'-AUAAAAUUCUCAAUUCAGAGA-3' | (SEQ ID NO: 1956) |
| HIF-1α-3640 21 nt Targ: | 5'-CAUCUGAUGUUUCUAUAGUCA-3' | (SEQ ID NO: 1957) |
| HIF-1α-3646 21 nt Targ: | 5'-AUGUUUCUAUAGUCACUUUGC-3' | (SEQ ID NO: 1958) |
| HIF-1α-3651 21 nt Targ: | 5'-UCUAUAGUCACUUUGCCAGCU-3' | (SEQ ID NO: 1959) |
| HIF-1α-3670 21 nt Targ: | 5'-CUCAAAAGAAAACAAUACCCU-3' | (SEQ ID NO: 1960) |
| HIF-1α-3743 21 nt Targ: | 5'-UGUUCUGCCUACCCUGUUGGU-3' | (SEQ ID NO: 1961) |
| HIF-1α-3745 21 nt Targ: | 5'-UUCUGCCUACCCUGUUGGUAU-3' | (SEQ ID NO: 1962) |
| HIF-1α-3746 21 nt Targ: | 5'-UCUGCCUACCCUGUUGGUAUA-3' | (SEQ ID NO: 1963) |
| HIF-1α-3748 21 nt Targ: | 5'-UGCCUACCCUGUUGGUAUAAA-3' | (SEQ ID NO: 1964) |
| HIF-1α-3749 21 nt Targ: | 5'-GCCUACCCUGUUGGUAUAAAG-3' | (SEQ ID NO: 1965) |
| HIF-1α-3754 21 nt Targ: | 5'-CCCUGUUGGUAUAAAGAUAUU-3' | (SEQ ID NO: 1966) |
| HIF-1α-3757 21 nt Targ: | 5'-UGUUGGUAUAAAGAUAUUUG-3' | (SEQ ID NO: 1967) |
| HIF-1α-3791 21 nt Targ: | 5'-CAAGAAAAAAAAAUCAUGCA-3' | (SEQ ID NO: 1968) |
| HIF-1α-3830 21 nt Targ: | 5'-AGUAUGUUAAUUUGCUCAAAA-3' | (SEQ ID NO: 1969) |
| HIF-1α-3861 21 nt Targ: | 5'-GAUUUUAUGCACUUUGUCGCU-3' | (SEQ ID NO: 1970) |
| HIF-1α-3863 21 nt Targ: | 5'-UUUUAUGCACUUUGUCGCUAU-3' | (SEQ ID NO: 1971) |
| HIF-1α-3865 21 nt Targ: | 5'-UUAUGCACUUUGUCGCUAUUA-3' | (SEQ ID NO: 1972) |
| HIF-1α-3867 21 nt Targ: | 5'-AUGCACUUUGUCGCUAUUAAC-3' | (SEQ ID NO: 1973) |
| HIF-1α-3869 21 nt Targ: | 5'-GCACUUUGUCGCUAUUAACAU-3' | (SEQ ID NO: 1974) |
| HIF-1α-3871 21 nt Targ: | 5'-ACUUUGUCGCUAUUAACAUCC-3' | (SEQ ID NO: 1975) |
| HIF-1α-3873 21 nt Targ: | 5'-UUUGUCGCUAUUAACAUCCUU-3' | (SEQ ID NO: 1976) |
| HIF-1α-3875 21 nt Targ: | 5'-UGUCGCUAUUAACAUCCUUUU-3' | (SEQ ID NO: 1977) |
| HIF-1α-3877 21 nt Targ: | 5'-UCGCUAUUAACAUCCUUUUUU-3' | (SEQ ID NO: 1978) |
| HIF-1α-3880 21 nt Targ: | 5'-CUAUUAACAUCCUUUUUUCA-3' | (SEQ ID NO: 1979) |
| HIF-1α-3916 21 nt Targ: | 5'-UUGAGUAAUUUUAGAAGCAUU-3' | (SEQ ID NO: 1980) |
| HIF-1α-3918 21 nt Targ: | 5'-GAGUAAUUUUAGAAGCAUUAU-3' | (SEQ ID NO: 1981) |
| HIF-1α-3920 21 nt Targ: | 5'-GUAAUUUUAGAAGCAUUAUUU-3' | (SEQ ID NO: 1982) |
| HIF-1α-3922 21 nt Targ: | 5'-AAUUUUAGAAGCAUUAUUUUA-3' | (SEQ ID NO: 1983) |
| HIF-1α-3924 21 nt Targ: | 5'-UUUUAGAAGCAUUAUUUUAGG-3' | (SEQ ID NO: 1984) |
| HIF-1α-3926 21 nt Targ: | 5'-UUAGAAGCAUUAUUUUAGGAA-3' | (SEQ ID NO: 1985) |

TABLE 5-continued

DsiRNA Target Sequences (21mers) In HIF-1α mRNA

| | | |
|---|---|---|
| HIF-1α-3928 21 nt Targ: | 5'-AGAAGCAUUAUUUUAGGAAUA-3' | (SEQ ID NO: 1986) |
| HIF-1α-3930 21 nt Targ: | 5'-AAGCAUUAUUUUAGGAAUAUA-3' | (SEQ ID NO: 1987) |
| HIF-1α-3961 21 nt Targ: | 5'-AGUAAAUAUCUUGUUUUUUCU-3' | (SEQ ID NO: 1988) |
| HIF-1α-3980 21 nt Targ: | 5'-CUAUGUACAUUGUACAAAUUU-3' | (SEQ ID NO: 1989) |
| HIF-1α-3999 21 nt Targ: | 5'-UUUUCAUUCCUUUUGCUCUUU-3' | (SEQ ID NO: 1990) |
| HIF-1α-4000 21 nt Targ: | 5'-UUUCAUUCCUUUUGCUCUUUG-3' | (SEQ ID NO: 1991) |
| HIF-1α-4001 21 nt Targ: | 5'-UUCAUUCCUUUUGCUCUUUGU-3' | (SEQ ID NO: 1992) |
| HIF-1α-4003 21 nt Targ: | 5'-CAUUCCUUUUGCUCUUUGUGG-3' | (SEQ ID NO: 1993) |
| HIF-1α-4004 21 nt Targ: | 5'-AUUCCUUUUGCUCUUUGUGGU-3' | (SEQ ID NO: 1994) |
| HIF-1α-4005 21 nt Targ: | 5'-UUCCUUUUGCUCUUUGUGGUU-3' | (SEQ ID NO: 1995) |
| HIF-1α-4006 21 nt Targ: | 5'-UCCUUUUGCUCUUUGUGGUUG-3' | (SEQ ID NO: 1996) |
| HIF-1α-4007 21 nt Targ: | 5'-CCUUUUGCUCUUUGUGGUUGG-3' | (SEQ ID NO: 1997) |
| HIF-1α-4008 21 nt Targ: | 5'-CUUUUGCUCUUUGUGGUUGGA-3' | (SEQ ID NO: 1998) |
| HIF-1α-4009 21 nt Targ: | 5'-UUUUGCUCUUUGUGGUUGGAU-3' | (SEQ ID NO: 1999) |
| HIF-1α-4010 21 nt Targ: | 5'-UUUGCUCUUUGUGGUUGGAUC-3' | (SEQ ID NO: 2000) |
| HIF-1α-4012 21 nt Targ: | 5'-UGCUCUUUGUGGUUGGAUCUA-3' | (SEQ ID NO: 2001) |
| HIF-1α-4055 21 nt Targ: | 5'-ACAUCAAAUAAACAUCUUCUG-3' | (SEQ ID NO: 2002) |
| HIF-1α-4057 21 nt Targ: | 5'-AUCAAAUAAACAUCUUCUGUG-3' | (SEQ ID NO: 2003) |
| HIF-1α-4059 21 nt Targ: | 5'-CAAAUAAACAUCUUCUGUGGA-3' | (SEQ ID NO: 2004) |
| HIF-1α-4061 21 nt Targ: | 5'-AAUAAACAUCUUCUGUGGACC-3' | (SEQ ID NO: 2005) |
| HIF-1α-4063 21 nt Targ: | 5'-UAAACAUCUUCUGUGGACCAG-3' | (SEQ ID NO: 2006) |
| HIF-1α-4065 21 nt Targ: | 5'-AACAUCUUCUGUGGACCAGGC-3' | (SEQ ID NO: 2007) |
| HIF-1α-m38 21 nt Targ: | 5'-GCCCGCGGGCGCGCGCGUUGG-3' | (SEQ ID NO: 2008) |
| HIF-1α-m40 21 nt Targ: | 5'-CCGCGGGCGCGCGCGUUGGGU-3' | (SEQ ID NO: 2009) |
| HIF-1α-m41 21 nt Targ: | 5'-CGCGGGCGCGCGCGUUGGGUG-3' | (SEQ ID NO: 2010) |
| HIF-1α-m42 21 nt Targ: | 5'-GCGGGCGCGCGCGUUGGGUGC-3' | (SEQ ID NO: 2011) |
| HIF-1α-m43 21 nt Targ: | 5'-CGGGCGCGCGCGUUGGGUGCU-3' | (SEQ ID NO: 2012) |
| HIF-1α-m44 21 nt Targ: | 5'-GGGCGCGCGCGUUGGGUGCUG-3' | (SEQ ID NO: 2013) |
| HIF-1α-m45 21 nt Targ: | 5'-GGCGCGCGCGUUGGGUGCUGA-3' | (SEQ ID NO: 2014) |
| HIF-1α-m46 21 nt Targ: | 5'-GCGCGCGCGUUGGGUGCUGAG-3' | (SEQ ID NO: 2015) |
| HIF-1α-m47 21 nt Targ: | 5'-CGCGCGCGUUGGGUGCUGAGC-3' | (SEQ ID NO: 2016) |
| HIF-1α-m49 21 nt Targ: | 5'-CGCGCGUUGGGUGCUGAGCGG-3' | (SEQ ID NO: 2017) |
| HIF-1α-m50 21 nt Targ: | 5'-GCGCGUUGGGUGCUGAGCGGG-3' | (SEQ ID NO: 2018) |
| HIF-1α-m51 21 nt Targ: | 5'-CGCGUUGGGUGCUGAGCGGGC-3' | (SEQ ID NO: 2019) |
| HIF-1α-m52 21 nt Targ: | 5'-GCGUUGGGUGCUGAGCGGGCG-3' | (SEQ ID NO: 2020) |
| HIF-1α-m53 21 nt Targ: | 5'-CGUUGGGUGCUGAGCGGGCGC-3' | (SEQ ID NO: 2021) |
| HIF-1α-m55 21 nt Targ: | 5'-UUGGGUGCUGAGCGGGCGCGC-3' | (SEQ ID NO: 2022) |
| HIF-1α-m97 21 nt Targ: | 5'-CCCUCGCCGCGCGCCCGAGCG-3' | (SEQ ID NO: 2023) |
| HIF-1α-m98 21 nt Targ: | 5'-CCUCGCCGCGCGCCCGAGCGC-3' | (SEQ ID NO: 2024) |

TABLE 5-continued

DsiRNA Target Sequences (21mers) In HIF-1α mRNA

| | | |
|---|---|---|
| HIF-1α-m99 21 nt Targ: | 5'-CUCGCCGCGCGCCCGAGCGCG-3' | (SEQ ID NO: 2025) |
| HIF-1α-m100 21 nt Targ: | 5'-UCGCCGCGCGCCCGAGCGCGC-3' | (SEQ ID NO: 2026) |
| HIF-1α-m139 21 nt Targ: | 5'-CCUGCCGCUGCUUCAGCGCCU-3' | (SEQ ID NO: 2027) |
| HIF-1α-m141 21 nt Targ: | 5'-UGCCGCUGCUUCAGCGCCUCA-3' | (SEQ ID NO: 2028) |
| HIF-1α-m145 21 nt Targ: | 5'-GCUGCUUCAGCGCCUCAGUGC-3' | (SEQ ID NO: 2029) |
| HIF-1α-m146 21 nt Targ: | 5'-CUGCUUCAGCGCCUCAGUGCA-3' | (SEQ ID NO: 2030) |
| HIF-1α-m148 21 nt Targ: | 5'-GCUUCAGCGCCUCAGUGCACA-3' | (SEQ ID NO: 2031) |
| HIF-1α-m152 21 nt Targ: | 5'-CAGCGCCUCAGUGCACAGAGC-3' | (SEQ ID NO: 2032) |
| HIF-1α-m271 21 nt Targ: | 5'-GAGCCGGAGCUCAGCGAGCGC-3' | (SEQ ID NO: 2033) |
| HIF-1α-m277 21 nt Targ: | 5'-GAGCUCAGCGAGCGCAGCCUG-3' | (SEQ ID NO: 2034) |
| HIF-1α-m282 21 nt Targ: | 5'-CAGCGAGCGCAGCCUGCAGCU-3' | (SEQ ID NO: 2035) |
| HIF-1α-m283 21 nt Targ: | 5'-AGCGAGCGCAGCCUGCAGCUC-3' | (SEQ ID NO: 2036) |
| HIF-1α-m284 21 nt Targ: | 5'-GCGAGCGCAGCCUGCAGCUCC-3' | (SEQ ID NO: 2037) |
| HIF-1α-m286 21 nt Targ: | 5'-GAGCGCAGCCUGCAGCUCCCG-3' | (SEQ ID NO: 2038) |
| HIF-1α-m289 21 nt Targ: | 5'-CGCAGCCUGCAGCUCCCGCCU-3' | (SEQ ID NO: 2039) |
| HIF-1α-m348 21 nt Targ: | 5'-UGGACUUGUCUCUUUCUCCGC-3' | (SEQ ID NO: 2040) |
| HIF-1α-m350 21 nt Targ: | 5'-GACUUGUCUCUUUCUCCGCGC-3' | (SEQ ID NO: 2041) |
| HIF-1α-m352 21 nt Targ: | 5'-CUUGUCUCUUUCUCCGCGCGC-3' | (SEQ ID NO: 2042) |
| HIF-1α-m353 21 nt Targ: | 5'-UUGUCUCUUUCUCCGCGCGCG-3' | (SEQ ID NO: 2043) |
| HIF-1α-m354 21 nt Targ: | 5'-UGUCUCUUUCUCCGCGCGCGC-3' | (SEQ ID NO: 2044) |
| HIF-1α-m357 21 nt Targ: | 5'-CUCUUUCUCCGCGCGCGCGGA-3' | (SEQ ID NO: 2045) |
| HIF-1α-m359 21 nt Targ: | 5'-CUUUCUCCGCGCGCGCGGACA-3' | (SEQ ID NO: 2046) |
| HIF-1α-m365 21 nt Targ: | 5'-CCGCGCGCGCGGACAGAGCCG-3' | (SEQ ID NO: 2047) |
| HIF-1α-m597 21 nt Targ: | 5'-GUGAGCUCACAUCUUGAUAAA-3' | (SEQ ID NO: 2048) |
| HIF-1α-m600 21 nt Targ: | 5'-AGCUCACAUCUUGAUAAAGCU-3' | (SEQ ID NO: 2049) |
| HIF-1α-m712 21 nt Targ: | 5'-UGGACUGUUUUUAUCUGAAAG-3' | (SEQ ID NO: 2050) |
| HIF-1α-m1093 21 nt Targ: | 5'-CACCCAUGACGUGCUUGGUGC-3' | (SEQ ID NO: 2051) |
| HIF-1α-m1593 21 nt Targ: | 5'-GAUACAAGCUGCCUUUUUGAU-3' | (SEQ ID NO: 2052) |
| HIF-1α-m1595 21 nt Targ: | 5'-UACAAGCUGCCUUUUUGAUAA-3' | (SEQ ID NO: 2053) |
| HIF-1α-m1596 21 nt Targ: | 5'-ACAAGCUGCCUUUUUGAUAAG-3' | (SEQ ID NO: 2054) |
| HIF-1α-m1599 21 nt Targ: | 5'-AGCUGCCUUUUUGAUAAGCUU-3' | (SEQ ID NO: 2055) |
| HIF-1α-m1632 21 nt Targ: | 5'-GAUGCUCUCACUCUGCUGGCU-3' | (SEQ ID NO: 2056) |
| HIF-1α-m1633 21 nt Targ: | 5'-AUGCUCUCACUCUGCUGGCUC-3' | (SEQ ID NO: 2057) |
| HIF-1α-m1634 21 nt Targ: | 5'-UGCUCUCACUCUGCUGGCUCC-3' | (SEQ ID NO: 2058) |
| HIF-1α-m1642 21 nt Targ: | 5'-CUCUGCUGGCUCCAGCUGCCG-3' | (SEQ ID NO: 2059) |
| HIF-1α-m1830 21 nt Targ: | 5'-CUUCGAAGUAGUGCUGAUCCU-3' | (SEQ ID NO: 2060) |
| HIF-1α-m2041 21 nt Targ: | 5'-AAUAUUGCUUUGAUGUGGAUA-3' | (SEQ ID NO: 2061) |
| HIF-1α-m2043 21 nt Targ: | 5'-UAUUGCUUUGAUGUGGAUAGC-3' | (SEQ ID NO: 2062) |
| HIF-1α-m2045 21 nt Targ: | 5'-UUGCUUUGAUGUGGAUAGCGA-3' | (SEQ ID NO: 2063) |

TABLE 5-continued

DsiRNA Target Sequences (21mers) In HIF-1α mRNA

| | | | |
|---|---|---|---|
| HIF-1α-m2650 21 nt Targ: | 5'-AUGAUGGCUCCCUUUUUCAAG-3' | (SEQ ID NO: 2064) |
| HIF-1α-m3030 21 nt Targ: | 5'-GUUUCUGUUGGUUAUUUUUGG-3' | (SEQ ID NO: 2065) |
| HIF-1α-m3557 21 nt Targ: | 5'-UGUUAAGCCUGGAUCAUGAAG-3' | (SEQ ID NO: 2066) |
| HIF-1α-m3562 21 nt Targ: | 5'-AGCCUGGAUCAUGAAGCUGUU-3' | (SEQ ID NO: 2067) |
| HIF-1α-m3576 21 nt Targ: | 5'-AGCUGUUGAUCUUAUAAUGAU-3' | (SEQ ID NO: 2068) |
| HIF-1α-m3592 21 nt Targ: | 5'-AUGAUUCUUAAACUGUAUGGU-3' | (SEQ ID NO: 2069) |
| HIF-1α-m3604 21 nt Targ: | 5'-CUGUAUGGUUUCUUUAUAUGG-3' | (SEQ ID NO: 2070) |
| HIF-1α-m4023 21 nt Targ: | 5'-CAUAGUAAACAUCUUGUUUUU-3' | (SEQ ID NO: 2071) |
| HIF-1α-m4064 21 nt Targ: | 5'-UUUUCGUUCCCUUGCUCUUUG-3' | (SEQ ID NO: 2072) |
| HIF-1α-m4065 21 nt Targ: | 5'-UUUCGUUCCCUUGCUCUUUGU-3' | (SEQ ID NO: 2073) |
| HIF-1α-m4070 21 nt Targ: | 5'-UUCCCUUGCUCUUUGUGGUUG-3' | (SEQ ID NO: 2074) |
| HIF-1α-m4549 21 nt Targ: | 5'-UUUCCGCGCUCUCAGGGAGCU-3' | (SEQ ID NO: 2075) |
| HIF-1α-m4691 21 nt Targ: | 5'-ACCUGAUGUUUCUUUACUUUG-3' | (SEQ ID NO: 2076) |
| HIF-1α-m4692 21 nt Targ: | 5'-CCUGAUGUUUCUUUACUUUGC-3' | (SEQ ID NO: 2077) |
| HIF-1α-m4693 21 nt Targ: | 5'-CUGAUGUUUCUUUACUUUGCC-3' | (SEQ ID NO: 2078) |
| HIF-1α-m4709 21 nt Targ: | 5'-UUGCCAGCUUUAAAAAGUAU-3' | (SEQ ID NO: 2079) |
| HIF-1α-463 21 nt Targ: | 5'-AAAGAUAAGUUCUGAACGUCG-3' | (SEQ ID NO: 3668) |
| HIF-1α-466 21 nt Targ: | 5'-GAUAAGUUCUGAACGUCGAAA-3' | (SEQ ID NO: 3669) |
| HIF-1α-468 21 nt Targ: | 5'-UAAGUUCUGAACGUCGAAAAG-3' | (SEQ ID NO: 3670) |
| HIF-1α-472 21 nt Targ: | 5'-UUCUGAACGUCGAAAAGAAAA-3' | (SEQ ID NO: 3671) |
| HIF-1α-480 21 nt Targ: | 5'-GUCGAAAAGAAAAGUCUCGAG-3' | (SEQ ID NO: 3672) |
| HIF-1α-481 21 nt Targ: | 5'-UCGAAAAGAAAAGUCUCGAGA-3' | (SEQ ID NO: 3673) |
| HIF-1α-516 21 nt Targ: | 5'-GGCGAAGUAAAGAAUCUGAAG-3' | (SEQ ID NO: 3674) |
| HIF-1α-517 21 nt Targ: | 5'-GCGAAGUAAAGAAUCUGAAGU-3' | (SEQ ID NO: 3675) |
| HIF-1α-519 21 nt Targ: | 5'-GAAGUAAAGAAUCUGAAGUUU-3' | (SEQ ID NO: 3676) |
| HIF-1α-520 21 nt Targ: | 5'-AAGUAAAGAAUCUGAAGUUUU-3' | (SEQ ID NO: 3677) |
| HIF-1α-522 21 nt Targ: | 5'-GUAAAGAAUCUGAAGUUUUUU-3' | (SEQ ID NO: 3678) |
| HIF-1α-529 21 nt Targ: | 5'-AUCUGAAGUUUUUUAUGAGCU-3' | (SEQ ID NO: 3679) |
| HIF-1α-557 21 nt Targ: | 5'-CAGUUGCCACUUCCACAUAAU-3' | (SEQ ID NO: 3680) |
| HIF-1α-576 21 nt Targ: | 5'-AUGUGAGUUCGCAUCUUGAUA-3' | (SEQ ID NO: 3681) |
| HIF-1α-608 21 nt Targ: | 5'-AUGAGGCUUACCAUCAGCUAU-3' | (SEQ ID NO: 3682) |
| HIF-1α-636 21 nt Targ: | 5'-UGAGGAAACUUCUGGAUGCUG-3' | (SEQ ID NO: 3683) |
| HIF-1α-652 21 nt Targ: | 5'-UGCUGGUGAUUUGGAUAUUGA-3' | (SEQ ID NO: 3684) |
| HIF-1α-654 21 nt Targ: | 5'-CUGGUGAUUUGGAUAUUGAAG-3' | (SEQ ID NO: 3685) |
| HIF-1α-660 21 nt Targ: | 5'-AUUUGGAUAUUGAAGAUGACA-3' | (SEQ ID NO: 3686) |
| HIF-1α-661 21 nt Targ: | 5'-UUUGGAUAUUGAAGAUGACAU-3' | (SEQ ID NO: 3687) |
| HIF-1α-663 21 nt Targ: | 5'-UGGAUAUUGAAGAUGACAUGA-3' | (SEQ ID NO: 3688) |
| HIF-1α-664 21 nt Targ: | 5'-GGAUAUUGAAGAUGACAUGAA-3' | (SEQ ID NO: 3689) |
| HIF-1α-671 21 nt Targ: | 5'-GAAGAUGACAUGAAAGCACAG-3' | (SEQ ID NO: 3690) |

TABLE 5-continued

DsiRNA Target Sequences (21mers) In HIF-1α mRNA

| | | |
|---|---|---|
| HIF-1α-672 21 nt Targ: | 5'-AAGAUGACAUGAAAGCACAGA-3' | (SEQ ID NO: 3691) |
| HIF-1α-681 21 nt Targ: | 5'-UGAAAGCACAGAUGAAUUGCU-3' | (SEQ ID NO: 3692) |
| HIF-1α-687 21 nt Targ: | 5'-CACAGAUGAAUUGCUUUUAUU-3' | (SEQ ID NO: 3693) |
| HIF-1α-688 21 nt Targ: | 5'-ACAGAUGAAUUGCUUUUAUUU-3' | (SEQ ID NO: 3694) |
| HIF-1α-701 21 nt Targ: | 5'-UUUUAUUUGAAAGCCUUGGAU-3' | (SEQ ID NO: 3695) |
| HIF-1α-702 21 nt Targ: | 5'-UUUAUUUGAAAGCCUUGGAUG-3' | (SEQ ID NO: 3696) |
| HIF-1α-708 21 nt Targ: | 5'-UGAAAGCCUUGGAUGGUUUUG-3' | (SEQ ID NO: 3697) |
| HIF-1α-723 21 nt Targ: | 5'-GUUUUGUUAUGGUUCUCACAG-3' | (SEQ ID NO: 3698) |
| HIF-1α-729 21 nt Targ: | 5'-UUAUGGUUCUCACAGAUGAUG-3' | (SEQ ID NO: 3699) |
| HIF-1α-730 21 nt Targ: | 5'-UAUGGUUCUCACAGAUGAUGG-3' | (SEQ ID NO: 3700) |
| HIF-1α-739 21 nt Targ: | 5'-CACAGAUGAUGGUGACAUGAU-3' | (SEQ ID NO: 3701) |
| HIF-1α-744 21 nt Targ: | 5'-AUGAUGGUGACAUGAUUUACA-3' | (SEQ ID NO: 3702) |
| HIF-1α-745 21 nt Targ: | 5'-UGAUGGUGACAUGAUUUACAU-3' | (SEQ ID NO: 3703) |
| HIF-1α-753 21 nt Targ: | 5'-ACAUGAUUUACAUUUCUGAUA-3' | (SEQ ID NO: 3704) |
| HIF-1α-755 21 nt Targ: | 5'-AUGAUUUACAUUUCUGAUAAU-3' | (SEQ ID NO: 3705) |
| HIF-1α-757 21 nt Targ: | 5'-GAUUUACAUUUCUGAUAAUGU-3' | (SEQ ID NO: 3706) |
| HIF-1α-762 21 nt Targ: | 5'-ACAUUUCUGAUAAUGUGAACA-3' | (SEQ ID NO: 3707) |
| HIF-1α-770 21 nt Targ: | 5'-GAUAAUGUGAACAAAUACAUG-3' | (SEQ ID NO: 3708) |
| HIF-1α-771 21 nt Targ: | 5'-AUAAUGUGAACAAAUACAUGG-3' | (SEQ ID NO: 3709) |
| HIF-1α-772 21 nt Targ: | 5'-UAAUGUGAACAAAUACAUGGG-3' | (SEQ ID NO: 3710) |
| HIF-1α-773 21 nt Targ: | 5'-AAUGUGAACAAAUACAUGGGA-3' | (SEQ ID NO: 3711) |
| HIF-1α-774 21 nt Targ: | 5'-AUGUGAACAAAUACAUGGGAU-3' | (SEQ ID NO: 3712) |
| HIF-1α-775 21 nt Targ: | 5'-UGUGAACAAAUACAUGGGAUU-3' | (SEQ ID NO: 3713) |
| HIF-1α-785 21 nt Targ: | 5'-UACAUGGGAUUAACUCAGUUU-3' | (SEQ ID NO: 3714) |
| HIF-1α-786 21 nt Targ: | 5'-ACAUGGGAUUAACUCAGUUUG-3' | (SEQ ID NO: 3715) |
| HIF-1α-801 21 nt Targ: | 5'-AGUUUGAACUAACUGGACACA-3' | (SEQ ID NO: 3716) |
| HIF-1α-811 21 nt Targ: | 5'-AACUGGACACAGUGUGUUUGA-3' | (SEQ ID NO: 3717) |
| HIF-1α-812 21 nt Targ: | 5'-ACUGGACACAGUGUGUUUGAU-3' | (SEQ ID NO: 3718) |
| HIF-1α-825 21 nt Targ: | 5'-UGUUUGAUUUUACUCAUCCAU-3' | (SEQ ID NO: 3719) |
| HIF-1α-827 21 nt Targ: | 5'-UUUGAUUUUACUCAUCCAUGU-3' | (SEQ ID NO: 3720) |
| HIF-1α-841 21 nt Targ: | 5'-UCCAUGUGACCAUGAGGAAAU-3' | (SEQ ID NO: 3721) |
| HIF-1α-843 21 nt Targ: | 5'-CAUGUGACCAUGAGGAAAUGA-3' | (SEQ ID NO: 3722) |
| HIF-1α-849 21 nt Targ: | 5'-ACCAUGAGGAAAUGAGAGAAA-3' | (SEQ ID NO: 3723) |
| HIF-1α-861 21 nt Targ: | 5'-UGAGAGAAAUGCUUACACACA-3' | (SEQ ID NO: 3724) |
| HIF-1α-865 21 nt Targ: | 5'-AGAAAUGCUUACACACAGAAA-3' | (SEQ ID NO: 3725) |
| HIF-1α-866 21 nt Targ: | 5'-GAAAUGCUUACACACAGAAAU-3' | (SEQ ID NO: 3726) |
| HIF-1α-880 21 nt Targ: | 5'-CAGAAAUGGCCUUGUGAAAAA-3' | (SEQ ID NO: 3727) |
| HIF-1α-881 21 nt Targ: | 5'-AGAAAUGGCCUUGUGAAAAAG-3' | (SEQ ID NO: 3728) |
| HIF-1α-882 21 nt Targ: | 5'-GAAAUGGCCUUGUGAAAAAGG-3' | (SEQ ID NO: 3729) |

TABLE 5-continued

DsiRNA Target Sequences (21mers) In HIF-1α mRNA

| | | |
|---|---|---|
| HIF-1α-883 21 nt Targ: | 5'-AAAUGGCCUUGUGAAAAAGGG-3' | (SEQ ID NO: 3730) |
| HIF-1α-888 21 nt Targ: | 5'-GCCUUGUGAAAAAGGGUAAAG-3' | (SEQ ID NO: 3731) |
| HIF-1α-904 21 nt Targ: | 5'-UAAAGAACAAAACACACAGCG-3' | (SEQ ID NO: 3732) |
| HIF-1α-926 21 nt Targ: | 5'-AGCUUUUUCUCAGAAUGAAG-3' | (SEQ ID NO: 3733) |
| HIF-1α-928 21 nt Targ: | 5'-CUUUUUCUCAGAAUGAAGUG-3' | (SEQ ID NO: 3734) |
| HIF-1α-938 21 nt Targ: | 5'-AGAAUGAAGUGUACCCUAACU-3' | (SEQ ID NO: 3735) |
| HIF-1α-962 21 nt Targ: | 5'-CGAGGAAGAACUAUGAACAUA-3' | (SEQ ID NO: 3736) |
| HIF-1α-963 21 nt Targ: | 5'-GAGGAAGAACUAUGAACAUAA-3' | (SEQ ID NO: 3737) |
| HIF-1α-964 21 nt Targ: | 5'-AGGAAGAACUAUGAACAUAAA-3' | (SEQ ID NO: 3738) |
| HIF-1α-1012 21 nt Targ: | 5'-CACAGGCCACAUUCACGUAUA-3' | (SEQ ID NO: 3739) |
| HIF-1α-1058 21 nt Targ: | 5'-UGUGGGUAUAAGAAACCACCU-3' | (SEQ ID NO: 3740) |
| HIF-1α-1059 21 nt Targ: | 5'-GUGGGUAUAAGAAACCACCUA-3' | (SEQ ID NO: 3741) |
| HIF-1α-1123 21 nt Targ: | 5'-AAAUAUUGAAAUUCCUUUAGA-3' | (SEQ ID NO: 3742) |
| HIF-1α-1129 21 nt Targ: | 5'-UGAAAUUCCUUUAGAUAGCAA-3' | (SEQ ID NO: 3743) |
| HIF-1α-1173 21 nt Targ: | 5'-UGGAUAUGAAAUUUCUUAUU-3' | (SEQ ID NO: 3744) |
| HIF-1α-1176 21 nt Targ: | 5'-AUAUGAAAUUUCUUAUUGUG-3' | (SEQ ID NO: 3745) |
| HIF-1α-1177 21 nt Targ: | 5'-UAUGAAAUUUCUUAUUGUGA-3' | (SEQ ID NO: 3746) |
| HIF-1α-1178 21 nt Targ: | 5'-AUGAAAUUUCUUAUUGUGAU-3' | (SEQ ID NO: 3747) |
| HIF-1α-1180 21 nt Targ: | 5'-GAAAUUUCUUAUUGUGAUGA-3' | (SEQ ID NO: 3748) |
| HIF-1α-1181 21 nt Targ: | 5'-AAAUUUCUUAUUGUGAUGAA-3' | (SEQ ID NO: 3749) |
| HIF-1α-1182 21 nt Targ: | 5'-AAUUUCUUAUUGUGAUGAAA-3' | (SEQ ID NO: 3750) |
| HIF-1α-1186 21 nt Targ: | 5'-UUCUUAUUGUGAUGAAAGAAU-3' | (SEQ ID NO: 3751) |
| HIF-1α-1191 21 nt Targ: | 5'-AUUGUGAUGAAAGAAUUACCG-3' | (SEQ ID NO: 3752) |
| HIF-1α-1193 21 nt Targ: | 5'-UGUGAUGAAAGAAUUACCGAA-3' | (SEQ ID NO: 3753) |
| HIF-1α-1198 21 nt Targ: | 5'-UGAAAGAAUUACCGAAUUGAU-3' | (SEQ ID NO: 3754) |
| HIF-1α-1199 21 nt Targ: | 5'-GAAAGAAUUACCGAAUUGAUG-3' | (SEQ ID NO: 3755) |
| HIF-1α-1200 21 nt Targ: | 5'-AAAGAAUUACCGAAUUGAUGG-3' | (SEQ ID NO: 3756) |
| HIF-1α-1201 21 nt Targ: | 5'-AAGAAUUACCGAAUUGAUGGG-3' | (SEQ ID NO: 3757) |
| HIF-1α-1215 21 nt Targ: | 5'-UGAUGGGAUAUGAGCCAGAAG-3' | (SEQ ID NO: 3758) |
| HIF-1α-1222 21 nt Targ: | 5'-AUAUGAGCCAGAAGAACUUUU-3' | (SEQ ID NO: 3759) |
| HIF-1α-1240 21 nt Targ: | 5'-UUUAGGCCGCUCAAUUUAUGA-3' | (SEQ ID NO: 3760) |
| HIF-1α-1254 21 nt Targ: | 5'-UUUAUGAAUAUUAUCAUGCUU-3' | (SEQ ID NO: 3761) |
| HIF-1α-1256 21 nt Targ: | 5'-UAUGAAUAUUAUCAUGCUUUG-3' | (SEQ ID NO: 3762) |
| HIF-1α-1287 21 nt Targ: | 5'-AUCUGACCAAAACUCAUCAUG-3' | (SEQ ID NO: 3763) |
| HIF-1α-1292 21 nt Targ: | 5'-ACCAAAACUCAUCAUGAUAUG-3' | (SEQ ID NO: 3764) |
| HIF-1α-1293 21 nt Targ: | 5'-CCAAAACUCAUCAUGAUAUGU-3' | (SEQ ID NO: 3765) |
| HIF-1α-1302 21 nt Targ: | 5'-AUCAUGAUAUGUUUACUAAAG-3' | (SEQ ID NO: 3766) |
| HIF-1α-1306 21 nt Targ: | 5'-UGAUAUGUUUACUAAAGGACA-3' | (SEQ ID NO: 3767) |
| HIF-1α-1362 21 nt Targ: | 5'-GAGGUGGAUAUGUCUGGGUUG-3' | (SEQ ID NO: 3768) |

TABLE 5-continued

DsiRNA Target Sequences (21mers) In HIF-1α mRNA

| | | | |
|---|---|---|---|
| HIF-1α-1376 21 nt Targ: | 5'-UGGGUUGAAACUCAAGCAACU-3' | (SEQ ID NO: 3769) |
| HIF-1α-1393 21 nt Targ: | 5'-AACUGUCAUAUAUAACACCAA-3' | (SEQ ID NO: 3770) |
| HIF-1α-1409 21 nt Targ: | 5'-ACCAAGAAUUCUCAACCACAG-3' | (SEQ ID NO: 3771) |
| HIF-1α-1425 21 nt Targ: | 5'-CACAGUGCAUUGUAUGUGUGA-3' | (SEQ ID NO: 3772) |
| HIF-1α-1426 21 nt Targ: | 5'-ACAGUGCAUUGUAUGUGUGAA-3' | (SEQ ID NO: 3773) |
| HIF-1α-1438 21 nt Targ: | 5'-AUGUGUGAAUUACGUUGUGAG-3' | (SEQ ID NO: 3774) |
| HIF-1α-1439 21 nt Targ: | 5'-UGUGUGAAUUACGUUGUGAGU-3' | (SEQ ID NO: 3775) |
| HIF-1α-1440 21 nt Targ: | 5'-GUGUGAAUUACGUUGUGAGUG-3' | (SEQ ID NO: 3776) |
| HIF-1α-1441 21 nt Targ: | 5'-UGUGAAUUACGUUGUGAGUGG-3' | (SEQ ID NO: 3777) |
| HIF-1α-1459 21 nt Targ: | 5'-UGGUAUUAUUCAGCACGACUU-3' | (SEQ ID NO: 3778) |
| HIF-1α-1477 21 nt Targ: | 5'-CUUGAUUUUCUCCCUUCAACA-3' | (SEQ ID NO: 3779) |
| HIF-1α-1494 21 nt Targ: | 5'-AACAAACAGAAUGUGUCCUUA-3' | (SEQ ID NO: 3780) |
| HIF-1α-1503 21 nt Targ: | 5'-AAUGUGUCCUUAAACCGGUUG-3' | (SEQ ID NO: 3781) |
| HIF-1α-1516 21 nt Targ: | 5'-ACCGGUUGAAUCUUCAGAUAU-3' | (SEQ ID NO: 3782) |
| HIF-1α-1517 21 nt Targ: | 5'-CCGGUUGAAUCUUCAGAUAUG-3' | (SEQ ID NO: 3783) |
| HIF-1α-1518 21 nt Targ: | 5'-CGGUUGAAUCUUCAGAUAUGA-3' | (SEQ ID NO: 3784) |
| HIF-1α-1520 21 nt Targ: | 5'-GUUGAAUCUUCAGAUAUGAAA-3' | (SEQ ID NO: 3785) |
| HIF-1α-1521 21 nt Targ: | 5'-UUGAAUCUUCAGAUAUGAAAA-3' | (SEQ ID NO: 3786) |
| HIF-1α-1531 21 nt Targ: | 5'-AGAUAUGAAAAUGACUCAGCU-3' | (SEQ ID NO: 3787) |
| HIF-1α-1532 21 nt Targ: | 5'-GAUAUGAAAAUGACUCAGCUA-3' | (SEQ ID NO: 3788) |
| HIF-1α-1559 21 nt Targ: | 5'-AAAGUUGAAUCAGAAGAUACA-3' | (SEQ ID NO: 3789) |
| HIF-1α-1561 21 nt Targ: | 5'-AGUUGAAUCAGAAGAUACAAG-3' | (SEQ ID NO: 3790) |
| HIF-1α-1569 21 nt Targ: | 5'-CAGAAGAUACAAGUAGCCUCU-3' | (SEQ ID NO: 3791) |
| HIF-1α-1570 21 nt Targ: | 5'-AGAAGAUACAAGUAGCCUCUU-3' | (SEQ ID NO: 3792) |
| HIF-1α-1571 21 nt Targ: | 5'-GAAGAUACAAGUAGCCUCUUU-3' | (SEQ ID NO: 3793) |
| HIF-1α-1586 21 nt Targ: | 5'-CUCUUUGACAAACUUAAGAAG-3' | (SEQ ID NO: 3794) |
| HIF-1α-1587 21 nt Targ: | 5'-UCUUUGACAAACUUAAGAAGG-3' | (SEQ ID NO: 3795) |
| HIF-1α-1609 21 nt Targ: | 5'-ACCUGAUGCUUUAACUUUGCU-3' | (SEQ ID NO: 3796) |
| HIF-1α-1641 21 nt Targ: | 5'-CUGGAGACACAAUCAUAUCUU-3' | (SEQ ID NO: 3797) |
| HIF-1α-1642 21 nt Targ: | 5'-UGGAGACACAAUCAUAUCUUU-3' | (SEQ ID NO: 3798) |
| HIF-1α-1701 21 nt Targ: | 5'-AACUUGAGGAAGUACCAUUAU-3' | (SEQ ID NO: 3799) |
| HIF-1α-1702 21 nt Targ: | 5'-ACUUGAGGAAGUACCAUUAUA-3' | (SEQ ID NO: 3800) |
| HIF-1α-1704 21 nt Targ: | 5'-UUGAGGAAGUACCAUUAUAUA-3' | (SEQ ID NO: 3801) |
| HIF-1α-1705 21 nt Targ: | 5'-UGAGGAAGUACCAUUAUAUAA-3' | (SEQ ID NO: 3802) |
| HIF-1α-1707 21 nt Targ: | 5'-AGGAAGUACCAUUAUAUAAUG-3' | (SEQ ID NO: 3803) |
| HIF-1α-1708 21 nt Targ: | 5'-GGAAGUACCAUUAUAUAAUGA-3' | (SEQ ID NO: 3804) |
| HIF-1α-1748 21 nt Targ: | 5'-AACGAAAAAUUACAGAAUAUA-3' | (SEQ ID NO: 3805) |
| HIF-1α-1749 21 nt Targ: | 5'-ACGAAAAAUUACAGAAUAUAA-3' | (SEQ ID NO: 3806) |
| HIF-1α-1752 21 nt Targ: | 5'-AAAAAUUACAGAAUAUAAAUU-3' | (SEQ ID NO: 3807) |

TABLE 5-continued

DsiRNA Target Sequences (21mers) In HIF-1α mRNA

| | | | |
|---|---|---|---|
| HIF-1α-1758 21 nt Targ: | 5'-UACAGAAUAUAAAUUUGGCAA-3' | (SEQ ID NO: 3808) |
| HIF-1α-1759 21 nt Targ: | 5'-ACAGAAUAUAAAUUUGGCAAU-3' | (SEQ ID NO: 3809) |
| HIF-1α-1842 21 nt Targ: | 5'-AUCAAGAAGUUGCAUUAAAAU-3' | (SEQ ID NO: 3810) |
| HIF-1α-1843 21 nt Targ: | 5'-UCAAGAAGUUGCAUUAAAAUU-3' | (SEQ ID NO: 3811) |
| HIF-1α-1857 21 nt Targ: | 5'-UAAAAUUAGAACCAAAUCCAG-3' | (SEQ ID NO: 3812) |
| HIF-1α-1858 21 nt Targ: | 5'-AAAAUUAGAACCAAAUCCAGA-3' | (SEQ ID NO: 3813) |
| HIF-1α-1874 21 nt Targ: | 5'-CCAGAGUCACUGGAACUUUCU-3' | (SEQ ID NO: 3814) |
| HIF-1α-1875 21 nt Targ: | 5'-CAGAGUCACUGGAACUUUCUU-3' | (SEQ ID NO: 3815) |
| HIF-1α-1881 21 nt Targ: | 5'-CACUGGAACUUUCUUUUACCA-3' | (SEQ ID NO: 3816) |
| HIF-1α-1966 21 nt Targ: | 5'-GCCUAAUAGUCCCAGUGAAUA-3' | (SEQ ID NO: 3817) |
| HIF-1α-1967 21 nt Targ: | 5'-CCUAAUAGUCCCAGUGAAUAU-3' | (SEQ ID NO: 3818) |
| HIF-1α-1968 21 nt Targ: | 5'-CUAAUAGUCCCAGUGAAUAUU-3' | (SEQ ID NO: 3819) |
| HIF-1α-1969 21 nt Targ: | 5'-UAAUAGUCCCAGUGAAUAUUG-3' | (SEQ ID NO: 3820) |
| HIF-1α-1970 21 nt Targ: | 5'-AAUAGUCCCAGUGAAUAUUGU-3' | (SEQ ID NO: 3821) |
| HIF-1α-1978 21 nt Targ: | 5'-CAGUGAAUAUUGUUUUUAUGU-3' | (SEQ ID NO: 3822) |
| HIF-1α-1979 21 nt Targ: | 5'-AGUGAAUAUUGUUUUUAUGUG-3' | (SEQ ID NO: 3823) |
| HIF-1α-1981 21 nt Targ: | 5'-UGAAUAUUGUUUUUAUGUGGA-3' | (SEQ ID NO: 3824) |
| HIF-1α-1983 21 nt Targ: | 5'-AAUAUUGUUUUUAUGUGGAUA-3' | (SEQ ID NO: 3825) |
| HIF-1α-1984 21 nt Targ: | 5'-AUAUUGUUUUUAUGUGGAUAG-3' | (SEQ ID NO: 3826) |
| HIF-1α-1986 21 nt Targ: | 5'-AUUGUUUUUAUGUGGAUAGUG-3' | (SEQ ID NO: 3827) |
| HIF-1α-1989 21 nt Targ: | 5'-GUUUUUAUGUGGAUAGUGAUA-3' | (SEQ ID NO: 3828) |
| HIF-1α-1996 21 nt Targ: | 5'-UGUGGAUAGUGAUAUGGUCAA-3' | (SEQ ID NO: 3829) |
| HIF-1α-1998 21 nt Targ: | 5'-UGGAUAGUGAUAUGGUCAAUG-3' | (SEQ ID NO: 3830) |
| HIF-1α-1999 21 nt Targ: | 5'-GGAUAGUGAUAUGGUCAAUGA-3' | (SEQ ID NO: 3831) |
| HIF-1α-2000 21 nt Targ: | 5'-GAUAGUGAUAUGGUCAAUGAA-3' | (SEQ ID NO: 3832) |
| HIF-1α-2004 21 nt Targ: | 5'-GUGAUAUGGUCAAUGAAUUCA-3' | (SEQ ID NO: 3833) |
| HIF-1α-2007 21 nt Targ: | 5'-AUAUGGUCAAUGAAUUCAAGU-3' | (SEQ ID NO: 3834) |
| HIF-1α-2008 21 nt Targ: | 5'-UAUGGUCAAUGAAUUCAAGUU-3' | (SEQ ID NO: 3835) |
| HIF-1α-2013 21 nt Targ: | 5'-UCAAUGAAUUCAAGUUGGAAU-3' | (SEQ ID NO: 3836) |
| HIF-1α-2014 21 nt Targ: | 5'-CAAUGAAUUCAAGUUGGAAUU-3' | (SEQ ID NO: 3837) |
| HIF-1α-2016 21 nt Targ: | 5'-AUGAAUUCAAGUUGGAAUUGG-3' | (SEQ ID NO: 3838) |
| HIF-1α-2022 21 nt Targ: | 5'-UCAAGUUGGAAUUGGUAGAAA-3' | (SEQ ID NO: 3839) |
| HIF-1α-2028 21 nt Targ: | 5'-UGGAAUUGGUAGAAAACUUU-3' | (SEQ ID NO: 3840) |
| HIF-1α-2029 21 nt Targ: | 5'-GGAAUUGGUAGAAAACUUUU-3' | (SEQ ID NO: 3841) |
| HIF-1α-2035 21 nt Targ: | 5'-GGUAGAAAACUUUUUGCUGA-3' | (SEQ ID NO: 3842) |
| HIF-1α-2036 21 nt Targ: | 5'-GUAGAAAACUUUUUGCUGAA-3' | (SEQ ID NO: 3843) |
| HIF-1α-2043 21 nt Targ: | 5'-AACUUUUUGCUGAAGACACAG-3' | (SEQ ID NO: 3844) |
| HIF-1α-2050 21 nt Targ: | 5'-UGCUGAAGACACAGAAGCAAA-3' | (SEQ ID NO: 3845) |
| HIF-1α-2051 21 nt Targ: | 5'-GCUGAAGACACAGAAGCAAAG-3' | (SEQ ID NO: 3846) |

TABLE 5-continued

DsiRNA Target Sequences (21mers) In HIF-1α mRNA

| | | |
|---|---|---|
| HIF-1α-2059 21 nt Targ: | 5'-CACAGAAGCAAAGAACCCAUU-3' | (SEQ ID NO: 3847) |
| HIF-1α-2068 21 nt Targ: | 5'-AAAGAACCCAUUUUCUACUCA-3' | (SEQ ID NO: 3848) |
| HIF-1α-2085 21 nt Targ: | 5'-CUCAGGACACAGAUUUAGACU-3' | (SEQ ID NO: 3849) |
| HIF-1α-2092 21 nt Targ: | 5'-CACAGAUUUAGACUUGGAGAU-3' | (SEQ ID NO: 3850) |
| HIF-1α-2094 21 nt Targ: | 5'-CAGAUUUAGACUUGGAGAUGU-3' | (SEQ ID NO: 3851) |
| HIF-1α-2095 21 nt Targ: | 5'-AGAUUUAGACUUGGAGAUGUU-3' | (SEQ ID NO: 3852) |
| HIF-1α-2105 21 nt Targ: | 5'-UUGGAGAUGUUAGCUCCCUAU-3' | (SEQ ID NO: 3853) |
| HIF-1α-2134 21 nt Targ: | 5'-GGAUGAUGACUUCCAGUUACG-3' | (SEQ ID NO: 3854) |
| HIF-1α-2159 21 nt Targ: | 5'-UUCGAUCAGUUGUCACCAUUA-3' | (SEQ ID NO: 3855) |
| HIF-1α-2166 21 nt Targ: | 5'-AGUUGUCACCAUUAGAAAGCA-3' | (SEQ ID NO: 3856) |
| HIF-1α-2221 21 nt Targ: | 5'-CACAGUUACAGUAUUCCAGCA-3' | (SEQ ID NO: 3857) |
| HIF-1α-2295 21 nt Targ: | 5'-AUGAAUUAAAAACAGUGACAA-3' | (SEQ ID NO: 3858) |
| HIF-1α-2296 21 nt Targ: | 5'-UGAAUUAAAAACAGUGACAAA-3' | (SEQ ID NO: 3859) |
| HIF-1α-2297 21 nt Targ: | 5'-GAAUUAAAAACAGUGACAAAA-3' | (SEQ ID NO: 3860) |
| HIF-1α-2305 21 nt Targ: | 5'-AACAGUGACAAAAGACCGUAU-3' | (SEQ ID NO: 3861) |
| HIF-1α-2307 21 nt Targ: | 5'-CAGUGACAAAAGACCGUAUGG-3' | (SEQ ID NO: 3862) |
| HIF-1α-2319 21 nt Targ: | 5'-ACCGUAUGGAAGACAUUAAAA-3' | (SEQ ID NO: 3863) |
| HIF-1α-2322 21 nt Targ: | 5'-GUAUGGAAGACAUUAAAAUAU-3' | (SEQ ID NO: 3864) |
| HIF-1α-2323 21 nt Targ: | 5'-UAUGGAAGACAUUAAAAUAUU-3' | (SEQ ID NO: 3865) |
| HIF-1α-2325 21 nt Targ: | 5'-UGGAAGACAUUAAAAUAUUGA-3' | (SEQ ID NO: 3866) |
| HIF-1α-2404 21 nt Targ: | 5'-AUAUAGAGAUACUCAAAGUCG-3' | (SEQ ID NO: 3867) |
| HIF-1α-2446 21 nt Targ: | 5'-AGGAAAAGGAGUCAUAGAACA-3' | (SEQ ID NO: 3868) |
| HIF-1α-2450 21 nt Targ: | 5'-AAAGGAGUCAUAGAACAGACA-3' | (SEQ ID NO: 3869) |
| HIF-1α-2451 21 nt Targ: | 5'-AAGGAGUCAUAGAACAGACAG-3' | (SEQ ID NO: 3870) |
| HIF-1α-2467 21 nt Targ: | 5'-GACAGAAAAAUCUCAUCCAAG-3' | (SEQ ID NO: 3871) |
| HIF-1α-2468 21 nt Targ: | 5'-ACAGAAAAAUCUCAUCCAAGA-3' | (SEQ ID NO: 3872) |
| HIF-1α-2495 21 nt Targ: | 5'-AACGUGUUAUCUGUCGCUUUG-3' | (SEQ ID NO: 3873) |
| HIF-1α-2496 21 nt Targ: | 5'-ACGUGUUAUCUGUCGCUUUGA-3' | (SEQ ID NO: 3874) |
| HIF-1α-2503 21 nt Targ: | 5'-AUCUGUCGCUUUGAGUCAAAG-3' | (SEQ ID NO: 3875) |
| HIF-1α-2510 21 nt Targ: | 5'-GCUUUGAGUCAAAGAACUACA-3' | (SEQ ID NO: 3876) |
| HIF-1α-2511 21 nt Targ: | 5'-CUUUGAGUCAAAGAACUACAG-3' | (SEQ ID NO: 3877) |
| HIF-1α-2517 21 nt Targ: | 5'-GUCAAAGAACUACAGUUCCUG-3' | (SEQ ID NO: 3878) |
| HIF-1α-2518 21 nt Targ: | 5'-UCAAAGAACUACAGUUCCUGA-3' | (SEQ ID NO: 3879) |
| HIF-1α-2535 21 nt Targ: | 5'-CUGAGGAAGAACUAAAUCCAA-3' | (SEQ ID NO: 3880) |
| HIF-1α-2536 21 nt Targ: | 5'-UGAGGAAGAACUAAAUCCAAA-3' | (SEQ ID NO: 3881) |
| HIF-1α-2537 21 nt Targ: | 5'-GAGGAAGAACUAAAUCCAAAG-3' | (SEQ ID NO: 3882) |
| HIF-1α-2538 21 nt Targ: | 5'-AGGAAGAACUAAAUCCAAAGA-3' | (SEQ ID NO: 3883) |
| HIF-1α-2546 21 nt Targ: | 5'-CUAAAUCCAAAGAUACUAGCU-3' | (SEQ ID NO: 3884) |
| HIF-1α-2551 21 nt Targ: | 5'-UCCAAAGAUACUAGCUUUGCA-3' | (SEQ ID NO: 3885) |

TABLE 5-continued

DsiRNA Target Sequences (21mers) In HIF-1α mRNA

| | | | |
|---|---|---|---|
| HIF-1α-2553 21 nt Targ: | 5'-CAAAGAUACUAGCUUUGCAGA-3' | (SEQ ID NO: 3886) |
| HIF-1α-2554 21 nt Targ: | 5'-AAAGAUACUAGCUUUGCAGAA-3' | (SEQ ID NO: 3887) |
| HIF-1α-2581 21 nt Targ: | 5'-GAGAAAGCGAAAAAUGGAACA-3' | (SEQ ID NO: 3888) |
| HIF-1α-2593 21 nt Targ: | 5'-AAUGGAACAUGAUGGUUCACU-3' | (SEQ ID NO: 3889) |
| HIF-1α-2599 21 nt Targ: | 5'-ACAUGAUGGUUCACUUUUUCA-3' | (SEQ ID NO: 3890) |
| HIF-1α-2611 21 nt Targ: | 5'-ACUUUUUCAAGCAGUAGGAAU-3' | (SEQ ID NO: 3891) |
| HIF-1α-2620 21 nt Targ: | 5'-AGCAGUAGGAAUUGGAACAUU-3' | (SEQ ID NO: 3892) |
| HIF-1α-2621 21 nt Targ: | 5'-GCAGUAGGAAUUGGAACAUUA-3' | (SEQ ID NO: 3893) |
| HIF-1α-2622 21 nt Targ: | 5'-CAGUAGGAAUUGGAACAUUAU-3' | (SEQ ID NO: 3894) |
| HIF-1α-2680 21 nt Targ: | 5'-UUCUUGGAAACGUGUAAAAGG-3' | (SEQ ID NO: 3895) |
| HIF-1α-2681 21 nt Targ: | 5'-UCUUGGAAACGUGUAAAAGGA-3' | (SEQ ID NO: 3896) |
| HIF-1α-2692 21 nt Targ: | 5'-UGUAAAAGGAUGCAAAUCUAG-3' | (SEQ ID NO: 3897) |
| HIF-1α-2693 21 nt Targ: | 5'-GUAAAAGGAUGCAAAUCUAGU-3' | (SEQ ID NO: 3898) |
| HIF-1α-2698 21 nt Targ: | 5'-AGGAUGCAAAUCUAGUGAACA-3' | (SEQ ID NO: 3899) |
| HIF-1α-2702 21 nt Targ: | 5'-UGCAAAUCUAGUGAACAGAAU-3' | (SEQ ID NO: 3900) |
| HIF-1α-2708 21 nt Targ: | 5'-UCUAGUGAACAGAAUGGAAUG-3' | (SEQ ID NO: 3901) |
| HIF-1α-2709 21 nt Targ: | 5'-CUAGUGAACAGAAUGGAAUGG-3' | (SEQ ID NO: 3902) |
| HIF-1α-2716 21 nt Targ: | 5'-ACAGAAUGGAAUGGAGCAAAA-3' | (SEQ ID NO: 3903) |
| HIF-1α-2721 21 nt Targ: | 5'-AUGGAAUGGAGCAAAAGACAA-3' | (SEQ ID NO: 3904) |
| HIF-1α-2723 21 nt Targ: | 5'-GGAAUGGAGCAAAAGACAAUU-3' | (SEQ ID NO: 3905) |
| HIF-1α-2724 21 nt Targ: | 5'-GAAUGGAGCAAAAGACAAUUA-3' | (SEQ ID NO: 3906) |
| HIF-1α-2725 21 nt Targ: | 5'-AAUGGAGCAAAAGACAAUUAU-3' | (SEQ ID NO: 3907) |
| HIF-1α-2726 21 nt Targ: | 5'-AUGGAGCAAAAGACAAUUAUU-3' | (SEQ ID NO: 3908) |
| HIF-1α-2738 21 nt Targ: | 5'-ACAAUUAUUUUAAUACCCUCU-3' | (SEQ ID NO: 3909) |
| HIF-1α-2739 21 nt Targ: | 5'-CAAUUAUUUUAAUACCCUCUG-3' | (SEQ ID NO: 3910) |
| HIF-1α-2740 21 nt Targ: | 5'-AAUUAUUUUAAUACCCUCUGA-3' | (SEQ ID NO: 3911) |
| HIF-1α-2742 21 nt Targ: | 5'-UUAUUUUAAUACCCUCUGAUU-3' | (SEQ ID NO: 3912) |
| HIF-1α-2743 21 nt Targ: | 5'-UAUUUUAAUACCCUCUGAUUU-3' | (SEQ ID NO: 3913) |
| HIF-1α-2776 21 nt Targ: | 5'-GCUGGGGCAAUCAAUGGAUGA-3' | (SEQ ID NO: 3914) |
| HIF-1α-2781 21 nt Targ: | 5'-GGCAAUCAAUGGAUGAAAGUG-3' | (SEQ ID NO: 3915) |
| HIF-1α-2817 21 nt Targ: | 5'-CCAGUUAUGAUUGUGAAGUUA-3' | (SEQ ID NO: 3916) |
| HIF-1α-2818 21 nt Targ: | 5'-CAGUUAUGAUUGUGAAGUUAA-3' | (SEQ ID NO: 3917) |
| HIF-1α-2826 21 nt Targ: | 5'-AUUGUGAAGUUAAUGCUCCUA-3' | (SEQ ID NO: 3918) |
| HIF-1α-2830 21 nt Targ: | 5'-UGAAGUUAAUGCUCCUAUACA-3' | (SEQ ID NO: 3919) |
| HIF-1α-2869 21 nt Targ: | 5'-GCAGGGUGAAGAAUUACUCAG-3' | (SEQ ID NO: 3920) |
| HIF-1α-2875 21 nt Targ: | 5'-UGAAGAAUUACUCAGAGCUUU-3' | (SEQ ID NO: 3921) |
| HIF-1α-2877 21 nt Targ: | 5'-AAGAAUUACUCAGAGCUUUGG-3' | (SEQ ID NO: 3922) |
| HIF-1α-2885 21 nt Targ: | 5'-CUCAGAGCUUUGGAUCAAGUU-3' | (SEQ ID NO: 3923) |
| HIF-1α-2900 21 nt Targ: | 5'-CAAGUUAACUGAGCUUUUUCU-3' | (SEQ ID NO: 3924) |

TABLE 5-continued

DsiRNA Target Sequences (21mers) In HIF-1α mRNA

| | | | |
|---|---|---|---|
| HIF-1α-2902 21 nt Targ: | 5'-AGUUAACUGAGCUUUUUCUUA-3' | (SEQ ID NO: 3925) |
| HIF-1α-2913 21 nt Targ: | 5'-CUUUUUCUUAAUUUCAUUCCU-3' | (SEQ ID NO: 3926) |
| HIF-1α-2918 21 nt Targ: | 5'-UCUUAAUUUCAUUCCUUUUUU-3' | (SEQ ID NO: 3927) |
| HIF-1α-2920 21 nt Targ: | 5'-UUAAUUUCAUUCCUUUUUUUG-3' | (SEQ ID NO: 3928) |
| HIF-1α-2943 21 nt Targ: | 5'-CACUGGUGGCUCAUUACCUAA-3' | (SEQ ID NO: 3929) |
| HIF-1α-2952 21 nt Targ: | 5'-CUCAUUACCUAAAGCAGUCUA-3' | (SEQ ID NO: 3930) |
| HIF-1α-2953 21 nt Targ: | 5'-UCAUUACCUAAAGCAGUCUAU-3' | (SEQ ID NO: 3931) |
| HIF-1α-2958 21 nt Targ: | 5'-ACCUAAAGCAGUCUAUUUAUA-3' | (SEQ ID NO: 3932) |
| HIF-1α-2960 21 nt Targ: | 5'-CUAAAGCAGUCUAUUUAUAUU-3' | (SEQ ID NO: 3933) |
| HIF-1α-2971 21 nt Targ: | 5'-UAUUUAUAUUUUCUACAUCUA-3' | (SEQ ID NO: 3934) |
| HIF-1α-2972 21 nt Targ: | 5'-AUUUAUAUUUUCUACAUCUAA-3' | (SEQ ID NO: 3935) |
| HIF-1α-2973 21 nt Targ: | 5'-UUUAUAUUUUCUACAUCUAAU-3' | (SEQ ID NO: 3936) |
| HIF-1α-2975 21 nt Targ: | 5'-UAUAUUUUCUACAUCUAAUUU-3' | (SEQ ID NO: 3937) |
| HIF-1α-2976 21 nt Targ: | 5'-AUAUUUUCUACAUCUAAUUUU-3' | (SEQ ID NO: 3938) |
| HIF-1α-3001 21 nt Targ: | 5'-GCCUGGCUACAAUACUGCACA-3' | (SEQ ID NO: 3939) |
| HIF-1α-3022 21 nt Targ: | 5'-AACUGGUUAGUUCAAUUUUG-3' | (SEQ ID NO: 3940) |
| HIF-1α-3029 21 nt Targ: | 5'-UUAGUUCAAUUUUGAUCCCU-3' | (SEQ ID NO: 3941) |
| HIF-1α-3037 21 nt Targ: | 5'-AUUUUGAUCCCCUUUCUACUU-3' | (SEQ ID NO: 3942) |
| HIF-1α-3038 21 nt Targ: | 5'-UUUUGAUCCCCUUUCUACUUA-3' | (SEQ ID NO: 3943) |
| HIF-1α-3039 21 nt Targ: | 5'-UUUGAUCCCCUUUCUACUUAA-3' | (SEQ ID NO: 3944) |
| HIF-1α-3046 21 nt Targ: | 5'-CCCUUUCUACUUAAUUUACAU-3' | (SEQ ID NO: 3945) |
| HIF-1α-3056 21 nt Targ: | 5'-UUAAUUUACAUUAAUGCUCUU-3' | (SEQ ID NO: 3946) |
| HIF-1α-3057 21 nt Targ: | 5'-UAAUUUACAUUAAUGCUCUUU-3' | (SEQ ID NO: 3947) |
| HIF-1α-3063 21 nt Targ: | 5'-ACAUUAAUGCUCUUUUUUAGU-3' | (SEQ ID NO: 3948) |
| HIF-1α-3064 21 nt Targ: | 5'-CAUUAAUGCUCUUUUUUAGUA-3' | (SEQ ID NO: 3949) |
| HIF-1α-3066 21 nt Targ: | 5'-UUAAUGCUCUUUUUUAGUAUG-3' | (SEQ ID NO: 3950) |
| HIF-1α-3074 21 nt Targ: | 5'-CUUUUUUAGUAUGUUCUUUAA-3' | (SEQ ID NO: 3951) |
| HIF-1α-3078 21 nt Targ: | 5'-UUUAGUAUGUUCUUUAAUGCU-3' | (SEQ ID NO: 3952) |
| HIF-1α-3079 21 nt Targ: | 5'-UUAGUAUGUUCUUUAAUGCUG-3' | (SEQ ID NO: 3953) |
| HIF-1α-3080 21 nt Targ: | 5'-UAGUAUGUUCUUUAAUGCUGG-3' | (SEQ ID NO: 3954) |
| HIF-1α-3103 21 nt Targ: | 5'-CACAGACAGCUCAUUUUCUCA-3' | (SEQ ID NO: 3955) |
| HIF-1α-3112 21 nt Targ: | 5'-CUCAUUUUCUCAGUUUUUGG-3' | (SEQ ID NO: 3956) |
| HIF-1α-3113 21 nt Targ: | 5'-UCAUUUUCUCAGUUUUUGGU-3' | (SEQ ID NO: 3957) |
| HIF-1α-3114 21 nt Targ: | 5'-CAUUUUCUCAGUUUUUGGUA-3' | (SEQ ID NO: 3958) |
| HIF-1α-3124 21 nt Targ: | 5'-GUUUUUGGUAUUUAAACCAU-3' | (SEQ ID NO: 3959) |
| HIF-1α-3128 21 nt Targ: | 5'-UUUGGUAUUUAAACCAUUGCA-3' | (SEQ ID NO: 3960) |
| HIF-1α-3129 21 nt Targ: | 5'-UUGGUAUUUAAACCAUUGCAU-3' | (SEQ ID NO: 3961) |
| HIF-1α-3134 21 nt Targ: | 5'-AUUUAAACCAUUGCAUUGCAG-3' | (SEQ ID NO: 3962) |
| HIF-1α-3146 21 nt Targ: | 5'-GCAUUGCAGUAGCAUCAUUUU-3' | (SEQ ID NO: 3963) |

TABLE 5-continued

DsiRNA Target Sequences (21mers) In HIF-1α mRNA

| | | |
|---|---|---|
| HIF-1α-3151 21 nt Targ: | 5'-GCAGUAGCAUCAUUUUAAAAA-3' | (SEQ ID NO: 3964) |
| HIF-1α-3152 21 nt Targ: | 5'-CAGUAGCAUCAUUUUAAAAAA-3' | (SEQ ID NO: 3965) |
| HIF-1α-3159 21 nt Targ: | 5'-AUCAUUUUAAAAAAUGCACCU-3' | (SEQ ID NO: 3966) |
| HIF-1α-3160 21 nt Targ: | 5'-UCAUUUUAAAAAAUGCACCUU-3' | (SEQ ID NO: 3967) |
| HIF-1α-3161 21 nt Targ: | 5'-CAUUUUAAAAAAUGCACCUUU-3' | (SEQ ID NO: 3968) |
| HIF-1α-3162 21 nt Targ: | 5'-AUUUUAAAAAAUGCACCUUUU-3' | (SEQ ID NO: 3969) |
| HIF-1α-3163 21 nt Targ: | 5'-UUUUAAAAAAUGCACCUUUUU-3' | (SEQ ID NO: 3970) |
| HIF-1α-3164 21 nt Targ: | 5'-UUUAAAAAAUGCACCUUUUUA-3' | (SEQ ID NO: 3971) |
| HIF-1α-3166 21 nt Targ: | 5'-UAAAAAAUGCACCUUUUUAUU-3' | (SEQ ID NO: 3972) |
| HIF-1α-3168 21 nt Targ: | 5'-AAAAAUGCACCUUUUUAUUUA-3' | (SEQ ID NO: 3973) |
| HIF-1α-3176 21 nt Targ: | 5'-ACCUUUUUAUUUAUUUAUUUU-3' | (SEQ ID NO: 3974) |
| HIF-1α-3182 21 nt Targ: | 5'-UUAUUUAUUUAUUUUUGGCUA-3' | (SEQ ID NO: 3975) |
| HIF-1α-3184 21 nt Targ: | 5'-AUUUAUUUAUUUUUGGCUAGG-3' | (SEQ ID NO: 3976) |
| HIF-1α-3185 21 nt Targ: | 5'-UUUAUUUAUUUUUGGCUAGGG-3' | (SEQ ID NO: 3977) |
| HIF-1α-3186 21 nt Targ: | 5'-UUAUUUAUUUUUGGCUAGGGA-3' | (SEQ ID NO: 3978) |
| HIF-1α-3187 21 nt Targ: | 5'-UAUUUAUUUUUGGCUAGGGAG-3' | (SEQ ID NO: 3979) |
| HIF-1α-3202 21 nt Targ: | 5'-AGGGAGUUUAUCCCUUUUUCG-3' | (SEQ ID NO: 3980) |
| HIF-1α-3203 21 nt Targ: | 5'-GGGAGUUUAUCCCUUUUUCGA-3' | (SEQ ID NO: 3981) |
| HIF-1α-3204 21 nt Targ: | 5'-GGAGUUUAUCCCUUUUUCGAA-3' | (SEQ ID NO: 3982) |
| HIF-1α-3205 21 nt Targ: | 5'-GAGUUUAUCCCUUUUUCGAAU-3' | (SEQ ID NO: 3983) |
| HIF-1α-3206 21 nt Targ: | 5'-AGUUUAUCCCUUUUUCGAAUU-3' | (SEQ ID NO: 3984) |
| HIF-1α-3207 21 nt Targ: | 5'-GUUUAUCCCUUUUUCGAAUUA-3' | (SEQ ID NO: 3985) |
| HIF-1α-3219 21 nt Targ: | 5'-UUCGAAUUAUUUUUAAGAAGA-3' | (SEQ ID NO: 3986) |
| HIF-1α-3224 21 nt Targ: | 5'-AUUAUUUUUAAGAAGAUGCCA-3' | (SEQ ID NO: 3987) |
| HIF-1α-3225 21 nt Targ: | 5'-UUAUUUUUAAGAAGAUGCCAA-3' | (SEQ ID NO: 3988) |
| HIF-1α-3227 21 nt Targ: | 5'-AUUUUUAAGAAGAUGCCAAUA-3' | (SEQ ID NO: 3989) |
| HIF-1α-3228 21 nt Targ: | 5'-UUUUUAAGAAGAUGCCAAUAU-3' | (SEQ ID NO: 3990) |
| HIF-1α-3230 21 nt Targ: | 5'-UUUAAGAAGAUGCCAAUAUAA-3' | (SEQ ID NO: 3991) |
| HIF-1α-3231 21 nt Targ: | 5'-UUAAGAAGAUGCCAAUAUAAU-3' | (SEQ ID NO: 3992) |
| HIF-1α-3233 21 nt Targ: | 5'-AAGAAGAUGCCAAUAUAAUUU-3' | (SEQ ID NO: 3993) |
| HIF-1α-3234 21 nt Targ: | 5'-AGAAGAUGCCAAUAUAAUUUU-3' | (SEQ ID NO: 3994) |
| HIF-1α-3235 21 nt Targ: | 5'-GAAGAUGCCAAUAUAAUUUUU-3' | (SEQ ID NO: 3995) |
| HIF-1α-3242 21 nt Targ: | 5'-CCAAUAUAAUUUUUGUAAGAA-3' | (SEQ ID NO: 3996) |
| HIF-1α-3246 21 nt Targ: | 5'-UAUAAUUUUUGUAAGAAGGCA-3' | (SEQ ID NO: 3997) |
| HIF-1α-3248 21 nt Targ: | 5'-UAAUUUUUGUAAGAAGGCAGU-3' | (SEQ ID NO: 3998) |
| HIF-1α-3277 21 nt Targ: | 5'-AUCAUGAUCAUAGGCAGUUGA-3' | (SEQ ID NO: 3999) |
| HIF-1α-3279 21 nt Targ: | 5'-CAUGAUCAUAGGCAGUUGAAA-3' | (SEQ ID NO: 4000) |
| HIF-1α-3283 21 nt Targ: | 5'-AUCAUAGGCAGUUGAAAAAUU-3' | (SEQ ID NO: 4001) |
| HIF-1α-3285 21 nt Targ: | 5'-CAUAGGCAGUUGAAAAAUUUU-3' | (SEQ ID NO: 4002) |

TABLE 5-continued

DsiRNA Target Sequences (21mers) In HIF-1α mRNA

| | | | |
|---|---|---|---|
| HIF-1α-3293 21 nt Targ: | 5'-GUUGAAAAAUUUUUACACCUU-3' | (SEQ ID NO: 4003) |
| HIF-1α-3294 21 nt Targ: | 5'-UUGAAAAAUUUUUACACCUUU-3' | (SEQ ID NO: 4004) |
| HIF-1α-3295 21 nt Targ: | 5'-UGAAAAAUUUUUACACCUUUU-3' | (SEQ ID NO: 4005) |
| HIF-1α-3296 21 nt Targ: | 5'-GAAAAAUUUUUACACCUUUUU-3' | (SEQ ID NO: 4006) |
| HIF-1α-3297 21 nt Targ: | 5'-AAAAAUUUUUACACCUUUUUU-3' | (SEQ ID NO: 4007) |
| HIF-1α-3311 21 nt Targ: | 5'-CUUUUUUUCACAUUUUACAU-3' | (SEQ ID NO: 4008) |
| HIF-1α-3312 21 nt Targ: | 5'-UUUUUUUCACAUUUUACAUA-3' | (SEQ ID NO: 4009) |
| HIF-1α-3313 21 nt Targ: | 5'-UUUUUUCACAUUUUACAUAA-3' | (SEQ ID NO: 4010) |
| HIF-1α-3314 21 nt Targ: | 5'-UUUUUCACAUUUUACAUAAA-3' | (SEQ ID NO: 4011) |
| HIF-1α-3320 21 nt Targ: | 5'-CACAUUUUACAUAAAUAAUAA-3' | (SEQ ID NO: 4012) |
| HIF-1α-3359 21 nt Targ: | 5'-UGGUAGCCACAAUUGCACAAU-3' | (SEQ ID NO: 4013) |
| HIF-1α-3375 21 nt Targ: | 5'-ACAAUAUAUUUUCUUAAAAAA-3' | (SEQ ID NO: 4014) |
| HIF-1α-3385 21 nt Targ: | 5'-UUCUUAAAAAAUACCAGCAGU-3' | (SEQ ID NO: 4015) |
| HIF-1α-3400 21 nt Targ: | 5'-AGCAGUUACUCAUGGAAUAUA-3' | (SEQ ID NO: 4016) |
| HIF-1α-3408 21 nt Targ: | 5'-CUCAUGGAAUAUAUUCUGCGU-3' | (SEQ ID NO: 4017) |
| HIF-1α-3409 21 nt Targ: | 5'-UCAUGGAAUAUAUUCUGCGUU-3' | (SEQ ID NO: 4018) |
| HIF-1α-3410 21 nt Targ: | 5'-CAUGGAAUAUAUUCUGCGUUU-3' | (SEQ ID NO: 4019) |
| HIF-1α-3411 21 nt Targ: | 5'-AUGGAAUAUAUUCUGCGUUUA-3' | (SEQ ID NO: 4020) |
| HIF-1α-3412 21 nt Targ: | 5'-UGGAAUAUAUUCUGCGUUUAU-3' | (SEQ ID NO: 4021) |
| HIF-1α-3413 21 nt Targ: | 5'-GGAAUAUAUUCUGCGUUUAUA-3' | (SEQ ID NO: 4022) |
| HIF-1α-3414 21 nt Targ: | 5'-GAAUAUAUUCUGCGUUUAUAA-3' | (SEQ ID NO: 4023) |
| HIF-1α-3429 21 nt Targ: | 5'-UUAUAAACUAGUUUUUAAGA-3' | (SEQ ID NO: 4024) |
| HIF-1α-3435 21 nt Targ: | 5'-AACUAGUUUUUAAGAAGAAAU-3' | (SEQ ID NO: 4025) |
| HIF-1α-3436 21 nt Targ: | 5'-ACUAGUUUUUAAGAAGAAAUU-3' | (SEQ ID NO: 4026) |
| HIF-1α-3437 21 nt Targ: | 5'-CUAGUUUUUAAGAAGAAAUUU-3' | (SEQ ID NO: 4027) |
| HIF-1α-3438 21 nt Targ: | 5'-UAGUUUUUAAGAAGAAAUUUU-3' | (SEQ ID NO: 4028) |
| HIF-1α-3441 21 nt Targ: | 5'-UUUUUAAGAAGAAAUUUUUUU-3' | (SEQ ID NO: 4029) |
| HIF-1α-3447 21 nt Targ: | 5'-AGAAGAAAUUUUUUUGGCCU-3' | (SEQ ID NO: 4030) |
| HIF-1α-3449 21 nt Targ: | 5'-AAGAAAUUUUUUUGGCCUAU-3' | (SEQ ID NO: 4031) |
| HIF-1α-3451 21 nt Targ: | 5'-GAAAUUUUUUUGGCCUAUGA-3' | (SEQ ID NO: 4032) |
| HIF-1α-3453 21 nt Targ: | 5'-AAUUUUUUUGGCCUAUGAAA-3' | (SEQ ID NO: 4033) |
| HIF-1α-3456 21 nt Targ: | 5'-UUUUUUGGCCUAUGAAAUUG-3' | (SEQ ID NO: 4034) |
| HIF-1α-3457 21 nt Targ: | 5'-UUUUUGGCCUAUGAAAUUGU-3' | (SEQ ID NO: 4035) |
| HIF-1α-3458 21 nt Targ: | 5'-UUUUGGCCUAUGAAAUUGUU-3' | (SEQ ID NO: 4036) |
| HIF-1α-3459 21 nt Targ: | 5'-UUUGGCCUAUGAAAUUGUUA-3' | (SEQ ID NO: 4037) |
| HIF-1α-3464 21 nt Targ: | 5'-GCCUAUGAAAUUGUUAAACCU-3' | (SEQ ID NO: 4038) |
| HIF-1α-3466 21 nt Targ: | 5'-CUAUGAAAUUGUUAAACCUGG-3' | (SEQ ID NO: 4039) |
| HIF-1α-3470 21 nt Targ: | 5'-GAAAUUGUUAAACCUGGAACA-3' | (SEQ ID NO: 4040) |
| HIF-1α-3471 21 nt Targ: | 5'-AAAUUGUUAAACCUGGAACAU-3' | (SEQ ID NO: 4041) |

TABLE 5-continued

DsiRNA Target Sequences (21mers) In HIF-1α mRNA

| | | | |
|---|---|---|---|
| HIF-1α-3481 21 nt Targ: | 5'-ACCUGGAACAUGACAUUGUUA-3' | (SEQ ID NO: 4042) |
| HIF-1α-3487 21 nt Targ: | 5'-AACAUGACAUUGUUAAUCAUA-3' | (SEQ ID NO: 4043) |
| HIF-1α-3488 21 nt Targ: | 5'-ACAUGACAUUGUUAAUCAUAU-3' | (SEQ ID NO: 4044) |
| HIF-1α-3492 21 nt Targ: | 5'-GACAUUGUUAAUCAUAUAAUA-3' | (SEQ ID NO: 4045) |
| HIF-1α-3494 21 nt Targ: | 5'-CAUUGUUAAUCAUAUAAUAAU-3' | (SEQ ID NO: 4046) |
| HIF-1α-3495 21 nt Targ: | 5'-AUUGUUAAUCAUAUAAUAAUG-3' | (SEQ ID NO: 4047) |
| HIF-1α-3496 21 nt Targ: | 5'-UUGUUAAUCAUAUAAUAAUGA-3' | (SEQ ID NO: 4048) |
| HIF-1α-3503 21 nt Targ: | 5'-UCAUAUAAUAAUGAUUCUUAA-3' | (SEQ ID NO: 4049) |
| HIF-1α-3504 21 nt Targ: | 5'-CAUAUAAUAAUGAUUCUUAAA-3' | (SEQ ID NO: 4050) |
| HIF-1α-3508 21 nt Targ: | 5'-UAAUAAUGAUUCUUAAAUGCU-3' | (SEQ ID NO: 4051) |
| HIF-1α-3511 21 nt Targ: | 5'-UAAUGAUUCUUAAAUGCUGUA-3' | (SEQ ID NO: 4052) |
| HIF-1α-3512 21 nt Targ: | 5'-AAUGAUUCUUAAAUGCUGUAU-3' | (SEQ ID NO: 4053) |
| HIF-1α-3513 21 nt Targ: | 5'-AUGAUUCUUAAAUGCUGUAUG-3' | (SEQ ID NO: 4054) |
| HIF-1α-3518 21 nt Targ: | 5'-UCUUAAAUGCUGUAUGGUUUA-3' | (SEQ ID NO: 4055) |
| HIF-1α-3519 21 nt Targ: | 5'-CUUAAAUGCUGUAUGGUUUAU-3' | (SEQ ID NO: 4056) |
| HIF-1α-3521 21 nt Targ: | 5'-UAAAUGCUGUAUGGUUUAUUA-3' | (SEQ ID NO: 4057) |
| HIF-1α-3528 21 nt Targ: | 5'-UGUAUGGUUUAUUAUUUAAAU-3' | (SEQ ID NO: 4058) |
| HIF-1α-3530 21 nt Targ: | 5'-UAUGGUUUAUUAUUUAAAUGG-3' | (SEQ ID NO: 4059) |
| HIF-1α-3531 21 nt Targ: | 5'-AUGGUUUAUUAUUUAAAUGGG-3' | (SEQ ID NO: 4060) |
| HIF-1α-3533 21 nt Targ: | 5'-GGUUUAUUAUUUAAAUGGGUA-3' | (SEQ ID NO: 4061) |
| HIF-1α-3534 21 nt Targ: | 5'-GUUUAUUAUUUAAAUGGGUAA-3' | (SEQ ID NO: 4062) |
| HIF-1α-3539 21 nt Targ: | 5'-UUAUUUAAAUGGGUAAAGCCA-3' | (SEQ ID NO: 4063) |
| HIF-1α-3545 21 nt Targ: | 5'-AAAUGGGUAAAGCCAUUUACA-3' | (SEQ ID NO: 4064) |
| HIF-1α-3548 21 nt Targ: | 5'-UGGGUAAAGCCAUUUACAUAA-3' | (SEQ ID NO: 4065) |
| HIF-1α-3550 21 nt Targ: | 5'-GGUAAAGCCAUUUACAUAAUA-3' | (SEQ ID NO: 4066) |
| HIF-1α-3551 21 nt Targ: | 5'-GUAAAGCCAUUUACAUAAUAU-3' | (SEQ ID NO: 4067) |
| HIF-1α-3556 21 nt Targ: | 5'-GCCAUUUACAUAAUAUAGAAA-3' | (SEQ ID NO: 4068) |
| HIF-1α-3565 21 nt Targ: | 5'-AUAAUAUAGAAAGAUAUGCAU-3' | (SEQ ID NO: 4069) |
| HIF-1α-3566 21 nt Targ: | 5'-UAAUAUAGAAAGAUAUGCAUA-3' | (SEQ ID NO: 4070) |
| HIF-1α-3567 21 nt Targ: | 5'-AAUAUAGAAAGAUAUGCAUAU-3' | (SEQ ID NO: 4071) |
| HIF-1α-3571 21 nt Targ: | 5'-UAGAAAGAUAUGCAUAUAUCU-3' | (SEQ ID NO: 4072) |
| HIF-1α-3574 21 nt Targ: | 5'-AAAGAUAUGCAUAUAUCUAGA-3' | (SEQ ID NO: 4073) |
| HIF-1α-3575 21 nt Targ: | 5'-AAGAUAUGCAUAUAUCUAGAA-3' | (SEQ ID NO: 4074) |
| HIF-1α-3576 21 nt Targ: | 5'-AGAUAUGCAUAUAUCUAGAAG-3' | (SEQ ID NO: 4075) |
| HIF-1α-3581 21 nt Targ: | 5'-UGCAUAUAUCUAGAAGGUAUG-3' | (SEQ ID NO: 4076) |
| HIF-1α-3582 21 nt Targ: | 5'-GCAUAUAUCUAGAAGGUAUGU-3' | (SEQ ID NO: 4077) |
| HIF-1α-3589 21 nt Targ: | 5'-UCUAGAAGGUAUGUGGCAUUU-3' | (SEQ ID NO: 4078) |
| HIF-1α-3593 21 nt Targ: | 5'-GAAGGUAUGUGGCAUUUAUUU-3' | (SEQ ID NO: 4079) |
| HIF-1α-3597 21 nt Targ: | 5'-GUAUGUGGCAUUUAUUUGGAU-3' | (SEQ ID NO: 4080) |

TABLE 5-continued

DsiRNA Target Sequences (21mers) In HIF-1α mRNA

| | | |
|---|---|---|
| HIF-1α-3599 21 nt Targ: | 5'-AUGUGGCAUUUAUUUGGAUAA-3' | (SEQ ID NO: 4081) |
| HIF-1α-3607 21 nt Targ: | 5'-UUUAUUUGGAUAAAAUUCUCA-3' | (SEQ ID NO: 4082) |
| HIF-1α-3613 21 nt Targ: | 5'-UGGAUAAAAUUCUCAAUUCAG-3' | (SEQ ID NO: 4083) |
| HIF-1α-3615 21 nt Targ: | 5'-GAUAAAAUUCUCAAUUCAGAG-3' | (SEQ ID NO: 4084) |
| HIF-1α-3617 21 nt Targ: | 5'-UAAAAUUCUCAAUUCAGAGAA-3' | (SEQ ID NO: 4085) |
| HIF-1α-3625 21 nt Targ: | 5'-UCAAUUCAGAGAAAUCAUCUG-3' | (SEQ ID NO: 4086) |
| HIF-1α-3629 21 nt Targ: | 5'-UUCAGAGAAAUCAUCUGAUGU-3' | (SEQ ID NO: 4087) |
| HIF-1α-3634 21 nt Targ: | 5'-AGAAAUCAUCUGAUGUUUCUA-3' | (SEQ ID NO: 4088) |
| HIF-1α-3642 21 nt Targ: | 5'-UCUGAUGUUUCUAUAGUCACU-3' | (SEQ ID NO: 4089) |
| HIF-1α-3643 21 nt Targ: | 5'-CUGAUGUUUCUAUAGUCACUU-3' | (SEQ ID NO: 4090) |
| HIF-1α-3671 21 nt Targ: | 5'-UCAAAGAAAACAAUACCCUA-3' | (SEQ ID NO: 4091) |
| HIF-1α-3673 21 nt Targ: | 5'-AAAAGAAAACAAUACCCUAUG-3' | (SEQ ID NO: 4092) |
| HIF-1α-3674 21 nt Targ: | 5'-AAAGAAAACAAUACCCUAUGU-3' | (SEQ ID NO: 4093) |
| HIF-1α-3676 21 nt Targ: | 5'-AGAAAACAAUACCCUAUGUAG-3' | (SEQ ID NO: 4094) |
| HIF-1α-3680 21 nt Targ: | 5'-AACAAUACCCUAUGUAGUUGU-3' | (SEQ ID NO: 4095) |
| HIF-1α-3688 21 nt Targ: | 5'-CCUAUGUAGUUGUGGAAGUUU-3' | (SEQ ID NO: 4096) |
| HIF-1α-3689 21 nt Targ: | 5'-CUAUGUAGUUGUGGAAGUUUA-3' | (SEQ ID NO: 4097) |
| HIF-1α-3694 21 nt Targ: | 5'-UAGUUGUGGAAGUUUAUGCUA-3' | (SEQ ID NO: 4098) |
| HIF-1α-3695 21 nt Targ: | 5'-AGUUGUGGAAGUUUAUGCUAA-3' | (SEQ ID NO: 4099) |
| HIF-1α-3697 21 nt Targ: | 5'-UUGUGGAAGUUUAUGCUAAUA-3' | (SEQ ID NO: 4100) |
| HIF-1α-3699 21 nt Targ: | 5'-GUGGAAGUUUAUGCUAAUAUU-3' | (SEQ ID NO: 4101) |
| HIF-1α-3700 21 nt Targ: | 5'-UGGAAGUUUAUGCUAAUAUUG-3' | (SEQ ID NO: 4102) |
| HIF-1α-3701 21 nt Targ: | 5'-GGAAGUUUAUGCUAAUAUUGU-3' | (SEQ ID NO: 4103) |
| HIF-1α-3703 21 nt Targ: | 5'-AAGUUUAUGCUAAUAUUGUGU-3' | (SEQ ID NO: 4104) |
| HIF-1α-3710 21 nt Targ: | 5'-UGCUAAUAUUGUGUAACUGAU-3' | (SEQ ID NO: 4105) |
| HIF-1α-3712 21 nt Targ: | 5'-CUAAUAUUGUGUAACUGAUAU-3' | (SEQ ID NO: 4106) |
| HIF-1α-3714 21 nt Targ: | 5'-AAUAUUGUGUAACUGAUAUUA-3' | (SEQ ID NO: 4107) |
| HIF-1α-3724 21 nt Targ: | 5'-AACUGAUAUUAAACCUAAAUG-3' | (SEQ ID NO: 4108) |
| HIF-1α-3756 21 nt Targ: | 5'-CUGUUGGUAUAAAGAUAUUUU-3' | (SEQ ID NO: 4109) |
| HIF-1α-3761 21 nt Targ: | 5'-GGUAUAAAGAUAUUUUGAGCA-3' | (SEQ ID NO: 4110) |
| HIF-1α-3765 21 nt Targ: | 5'-UAAAGAUAUUUUGAGCAGACU-3' | (SEQ ID NO: 4111) |
| HIF-1α-3766 21 nt Targ: | 5'-AAAGAUAUUUUGAGCAGACUG-3' | (SEQ ID NO: 4112) |
| HIF-1α-3767 21 nt Targ: | 5'-AAGAUAUUUUGAGCAGACUGU-3' | (SEQ ID NO: 4113) |
| HIF-1α-3772 21 nt Targ: | 5'-AUUUUGAGCAGACUGUAAACA-3' | (SEQ ID NO: 4114) |
| HIF-1α-3774 21 nt Targ: | 5'-UUUGAGCAGACUGUAAACAAG-3' | (SEQ ID NO: 4115) |
| HIF-1α-3778 21 nt Targ: | 5'-AGCAGACUGUAAACAAGAAAA-3' | (SEQ ID NO: 4116) |
| HIF-1α-3782 21 nt Targ: | 5'-GACUGUAAACAAGAAAAAAAA-3' | (SEQ ID NO: 4117) |
| HIF-1α-3783 21 nt Targ: | 5'-ACUGUAAACAAGAAAAAAAAA-3' | (SEQ ID NO: 4118) |
| HIF-1α-3795 21 nt Targ: | 5'-AAAAAAAAAAUCAUGCAUUCU-3' | (SEQ ID NO: 4119) |

TABLE 5-continued

DsiRNA Target Sequences (21mers) In HIF-1α mRNA

| | | | |
|---|---|---|---|
| HIF-1α-3796 21 nt Targ: | 5'-AAAAAAAAAUCAUGCAUUCUU-3' | (SEQ ID NO: 4120) |
| HIF-1α-3804 21 nt Targ: | 5'-AUCAUGCAUUCUUAGCAAAAU-3' | (SEQ ID NO: 4121) |
| HIF-1α-3812 21 nt Targ: | 5'-UUCUUAGCAAAAUUGCCUAGU-3' | (SEQ ID NO: 4122) |
| HIF-1α-3813 21 nt Targ: | 5'-UCUUAGCAAAAUUGCCUAGUA-3' | (SEQ ID NO: 4123) |
| HIF-1α-3818 21 nt Targ: | 5'-GCAAAAUUGCCUAGUAUGUUA-3' | (SEQ ID NO: 4124) |
| HIF-1α-3820 21 nt Targ: | 5'-AAAAUUGCCUAGUAUGUUAAU-3' | (SEQ ID NO: 4125) |
| HIF-1α-3821 21 nt Targ: | 5'-AAAUUGCCUAGUAUGUUAAUU-3' | (SEQ ID NO: 4126) |
| HIF-1α-3827 21 nt Targ: | 5'-CCUAGUAUGUUAAUUUGCUCA-3' | (SEQ ID NO: 4127) |
| HIF-1α-3828 21 nt Targ: | 5'-CUAGUAUGUUAAUUUGCUCAA-3' | (SEQ ID NO: 4128) |
| HIF-1α-3829 21 nt Targ: | 5'-UAGUAUGUUAAUUUGCUCAAA-3' | (SEQ ID NO: 4129) |
| HIF-1α-3835 21 nt Targ: | 5'-GUUAAUUUGCUCAAAAUACAA-3' | (SEQ ID NO: 4130) |
| HIF-1α-3836 21 nt Targ: | 5'-UUAAUUUGCUCAAAAUACAAU-3' | (SEQ ID NO: 4131) |
| HIF-1α-3838 21 nt Targ: | 5'-AAUUUGCUCAAAAUACAAUGU-3' | (SEQ ID NO: 4132) |
| HIF-1α-3844 21 nt Targ: | 5'-CUCAAAAUACAAUGUUUGAUU-3' | (SEQ ID NO: 4133) |
| HIF-1α-3846 21 nt Targ: | 5'-CAAAAUACAAUGUUUGAUUUU-3' | (SEQ ID NO: 4134) |
| HIF-1α-3847 21 nt Targ: | 5'-AAAAUACAAUGUUUGAUUUUA-3' | (SEQ ID NO: 4135) |
| HIF-1α-3853 21 nt Targ: | 5'-CAAUGUUUGAUUUUAUGCACU-3' | (SEQ ID NO: 4136) |
| HIF-1α-3854 21 nt Targ: | 5'-AAUGUUUGAUUUUAUGCACUU-3' | (SEQ ID NO: 4137) |
| HIF-1α-3864 21 nt Targ: | 5'-UUUAUGCACUUUGUCGCUAUU-3' | (SEQ ID NO: 4138) |
| HIF-1α-3872 21 nt Targ: | 5'-CUUUGUCGCUAUUAACAUCCU-3' | (SEQ ID NO: 4139) |
| HIF-1α-3891 21 nt Targ: | 5'-CUUUUUUUCAUGUAGAUUUCA-3' | (SEQ ID NO: 4140) |
| HIF-1α-3892 21 nt Targ: | 5'-UUUUUUUCAUGUAGAUUUCAA-3' | (SEQ ID NO: 4141) |
| HIF-1α-3897 21 nt Targ: | 5'-UUCAUGUAGAUUUCAAUAAUU-3' | (SEQ ID NO: 4142) |
| HIF-1α-3898 21 nt Targ: | 5'-UCAUGUAGAUUUCAAUAAUUG-3' | (SEQ ID NO: 4143) |
| HIF-1α-3899 21 nt Targ: | 5'-CAUGUAGAUUUCAAUAAUUGA-3' | (SEQ ID NO: 4144) |
| HIF-1α-3900 21 nt Targ: | 5'-AUGUAGAUUUCAAUAAUUGAG-3' | (SEQ ID NO: 4145) |
| HIF-1α-3901 21 nt Targ: | 5'-UGUAGAUUUCAAUAAUUGAGU-3' | (SEQ ID NO: 4146) |
| HIF-1α-3902 21 nt Targ: | 5'-GUAGAUUUCAAUAAUUGAGUA-3' | (SEQ ID NO: 4147) |
| HIF-1α-3903 21 nt Targ: | 5'-UAGAUUUCAAUAAUUGAGUAA-3' | (SEQ ID NO: 4148) |
| HIF-1α-3904 21 nt Targ: | 5'-AGAUUUCAAUAAUUGAGUAAU-3' | (SEQ ID NO: 4149) |
| HIF-1α-3910 21 nt Targ: | 5'-CAAUAAUUGAGUAAUUUUAGA-3' | (SEQ ID NO: 4150) |
| HIF-1α-3914 21 nt Targ: | 5'-AAUUGAGUAAUUUUAGAAGCA-3' | (SEQ ID NO: 4151) |
| HIF-1α-3915 21 nt Targ: | 5'-AUUGAGUAAUUUUAGAAGCAU-3' | (SEQ ID NO: 4152) |
| HIF-1α-3917 21 nt Targ: | 5'-UGAGUAAUUUUAGAAGCAUUA-3' | (SEQ ID NO: 4153) |
| HIF-1α-3921 21 nt Targ: | 5'-UAAUUUUAGAAGCAUUAUUUU-3' | (SEQ ID NO: 4154) |
| HIF-1α-3925 21 nt Targ: | 5'-UUUAGAAGCAUUAUUUUAGGA-3' | (SEQ ID NO: 4155) |
| HIF-1α-3927 21 nt Targ: | 5'-UAGAAGCAUUAUUUUAGGAAU-3' | (SEQ ID NO: 4156) |
| HIF-1α-3931 21 nt Targ: | 5'-AGCAUUAUUUUAGGAAUAUAU-3' | (SEQ ID NO: 4157) |
| HIF-1α-3933 21 nt Targ: | 5'-CAUUAUUUUAGGAAUAUAUAG-3' | (SEQ ID NO: 4158) |

TABLE 5-continued

DsiRNA Target Sequences (21mers) In HIF-1α mRNA

| | | |
|---|---|---|
| HIF-1α-3941 21 nt Targ: | 5'-UAGGAAUAUAUAGUUGUCACA-3' | (SEQ ID NO: 4159) |
| HIF-1α-3942 21 nt Targ: | 5'-AGGAAUAUAUAGUUGUCACAG-3' | (SEQ ID NO: 4160) |
| HIF-1α-3943 21 nt Targ: | 5'-GGAAUAUAUAGUUGUCACAGU-3' | (SEQ ID NO: 4161) |
| HIF-1α-3945 21 nt Targ: | 5'-AAUAUAUAGUUGUCACAGUAA-3' | (SEQ ID NO: 4162) |
| HIF-1α-3946 21 nt Targ: | 5'-AUAUAUAGUUGUCACAGUAAA-3' | (SEQ ID NO: 4163) |
| HIF-1α-3951 21 nt Targ: | 5'-UAGUUGUCACAGUAAAUAUCU-3' | (SEQ ID NO: 4164) |
| HIF-1α-3952 21 nt Targ: | 5'-AGUUGUCACAGUAAAUAUCUU-3' | (SEQ ID NO: 4165) |
| HIF-1α-3962 21 nt Targ: | 5'-GUAAAUAUCUUGUUUUUUCUA-3' | (SEQ ID NO: 4166) |
| HIF-1α-3963 21 nt Targ: | 5'-UAAAUAUCUUGUUUUUUCUAU-3' | (SEQ ID NO: 4167) |
| HIF-1α-3968 21 nt Targ: | 5'-AUCUUGUUUUUCUAUGUACA-3' | (SEQ ID NO: 4168) |
| HIF-1α-3969 21 nt Targ: | 5'-UCUUGUUUUUCUAUGUACAU-3' | (SEQ ID NO: 4169) |
| HIF-1α-3970 21 nt Targ: | 5'-CUUGUUUUUCUAUGUACAUU-3' | (SEQ ID NO: 4170) |
| HIF-1α-3971 21 nt Targ: | 5'-UUGUUUUUCUAUGUACAUUG-3' | (SEQ ID NO: 4171) |
| HIF-1α-3978 21 nt Targ: | 5'-UUCUAUGUACAUUGUACAAAU-3' | (SEQ ID NO: 4172) |
| HIF-1α-3979 21 nt Targ: | 5'-UCUAUGUACAUUGUACAAAUU-3' | (SEQ ID NO: 4173) |
| HIF-1α-3997 21 nt Targ: | 5'-AUUUUCAUUCCUUUUGCUCU-3' | (SEQ ID NO: 4174) |
| HIF-1α-4021 21 nt Targ: | 5'-UGGUUGGAUCUAACACUAACU-3' | (SEQ ID NO: 4175) |
| HIF-1α-4022 21 nt Targ: | 5'-GGUUGGAUCUAACACUAACUG-3' | (SEQ ID NO: 4176) |
| HIF-1α-4024 21 nt Targ: | 5'-UUGGAUCUAACACUAACUGUA-3' | (SEQ ID NO: 4177) |
| HIF-1α-4040 21 nt Targ: | 5'-CUGUAUUGUUUUGUUACAUCA-3' | (SEQ ID NO: 4178) |
| HIF-1α-4041 21 nt Targ: | 5'-UGUAUUGUUUUGUUACAUCAA-3' | (SEQ ID NO: 4179) |
| HIF-1α-4042 21 nt Targ: | 5'-GUAUUGUUUUGUUACAUCAAA-3' | (SEQ ID NO: 4180) |
| HIF-1α-4044 21 nt Targ: | 5'-AUUGUUUUGUUACAUCAAAUA-3' | (SEQ ID NO: 4181) |
| HIF-1α-4072 21 nt Targ: | 5'-UCUGUGGACCAGGCAAAAAAA-3' | (SEQ ID NO: 4182) |
| HIF-1α-4073 21 nt Targ: | 5'-CUGUGGACCAGGCAAAAAAAA-3' | (SEQ ID NO: 4183) |
| HIF-1α-4079 21 nt Targ: | 5'-ACCAGGCAAAAAAAAAAAAAA-3' | (SEQ ID NO: 4184) |
| HIF-1α-2610t2 21 nt Targ: | 5'-CACUUUUCAAGCAGUAGGAA-3' | (SEQ ID NO: 4185) |
| HIF-1α-2611t2 21 nt Targ: | 5'-ACUUUUCAAGCAGUAGGAAU-3' | (SEQ ID NO: 4186) |
| HIF-1α-2616t2 21 nt Targ: | 5'-UUCAAGCAGUAGGAAUUAUUU-3' | (SEQ ID NO: 4187) |
| HIF-1α-2620t2 21 nt Targ: | 5'-AGCAGUAGGAAUUAUUUAGCA-3' | (SEQ ID NO: 4188) |
| HIF-1α-2622t2 21 nt Targ: | 5'-CAGUAGGAAUUAUUUAGCAUG-3' | (SEQ ID NO: 4189) |
| HIF-1α-2623t2 21 nt Targ: | 5'-AGUAGGAAUUAUUUAGCAUGU-3' | (SEQ ID NO: 4190) |
| HIF-1α-2624t2 21 nt Targ: | 5'-GUAGGAAUUAUUUAGCAUGUA-3' | (SEQ ID NO: 4191) |

21mer Targets as cDNAs

| | | |
|---|---|---|
| HIF-1α-81 21 nt Targ: | 5'-CCGCGCGCCCGAGCGCGCCTC-3' | (SEQ ID NO: 4192) |
| HIF-1α-83 21 nt Targ: | 5'-GCGCGCCCGAGCGCGCCTCCG-3' | (SEQ ID NO: 4193) |
| HIF-1α-85 21 nt Targ: | 5'-GCGCCCGAGCGCGCCTCCGCC-3' | (SEQ ID NO: 4194) |
| HIF-1α-87 21 nt Targ: | 5'-GCCCGAGCGCGCCTCCGCCCT-3' | (SEQ ID NO: 4195) |
| HIF-1α-89 21 nt Targ: | 5'-CCGAGCGCGCCTCCGCCCTTG-3' | (SEQ ID NO: 4196) |

TABLE 5-continued

| DsiRNA Target Sequences (21mers) In HIF-1α mRNA | | |
|---|---|---|
| HIF-1α-123 21 nt Targ: | 5'-GCTGCCTCAGCTCCTCAGTGC-3' | (SEQ ID NO: 4197) |
| HIF-1α-124 21 nt Targ: | 5'-CTGCCTCAGCTCCTCAGTGCA-3' | (SEQ ID NO: 4198) |
| HIF-1α-126 21 nt Targ: | 5'-GCCTCAGCTCCTCAGTGCACA-3' | (SEQ ID NO: 4199) |
| HIF-1α-130 21 nt Targ: | 5'-CAGCTCCTCAGTGCACAGTGC-3' | (SEQ ID NO: 4200) |
| HIF-1α-131 21 nt Targ: | 5'-AGCTCCTCAGTGCACAGTGCT-3' | (SEQ ID NO: 4201) |
| HIF-1α-147 21 nt Targ: | 5'-GTGCTGCCTCGTCTGAGGGGA-3' | (SEQ ID NO: 4202) |
| HIF-1α-265 21 nt Targ: | 5'-GATTGCCGCCCGCTTCTCTCT-3' | (SEQ ID NO: 4203) |
| HIF-1α-267 21 nt Targ: | 5'-TTGCCGCCCGCTTCTCTCTAG-3' | (SEQ ID NO: 4204) |
| HIF-1α-268 21 nt Targ: | 5'-TGCCGCCCGCTTCTCTCTAGT-3' | (SEQ ID NO: 4205) |
| HIF-1α-292 21 nt Targ: | 5'-ACGAGGGGTTTCCCGCCTCGC-3' | (SEQ ID NO: 4206) |
| HIF-1α-319 21 nt Targ: | 5'-ACCTCTGGACTTGCCTTTCCT-3' | (SEQ ID NO: 4207) |
| HIF-1α-322 21 nt Targ: | 5'-TCTGGACTTGCCTTTCCTTCT-3' | (SEQ ID NO: 4208) |
| HIF-1α-324 21 nt Targ: | 5'-TGGACTTGCCTTTCCTTCTCT-3' | (SEQ ID NO: 4209) |
| HIF-1α-327 21 nt Targ: | 5'-ACTTGCCTTTCCTTCTCTTCT-3' | (SEQ ID NO: 4210) |
| HIF-1α-329 21 nt Targ: | 5'-TTGCCTTTCCTTCTCTTCTCC-3' | (SEQ ID NO: 4211) |
| HIF-1α-330 21 nt Targ: | 5'-TGCCTTTCCTTCTCTTCTCCG-3' | (SEQ ID NO: 4212) |
| HIF-1α-331 21 nt Targ: | 5'-GCCTTTCCTTCTCTTCTCCGC-3' | (SEQ ID NO: 4213) |
| HIF-1α-342 21 nt Targ: | 5'-TCTTCTCCGCGTGTGGAGGGA-3' | (SEQ ID NO: 4214) |
| HIF-1α-344 21 nt Targ: | 5'-TTCTCCGCGTGTGGAGGGAGC-3' | (SEQ ID NO: 4215) |
| HIF-1α-346 21 nt Targ: | 5'-CTCCGCGTGTGGAGGGAGCCA-3' | (SEQ ID NO: 4216) |
| HIF-1α-359 21 nt Targ: | 5'-GGGAGCCAGCGCTTAGGCCGG-3' | (SEQ ID NO: 4217) |
| HIF-1α-403 21 nt Targ: | 5'-GTGAAGACATCGCGGGGACCG-3' | (SEQ ID NO: 4218) |
| HIF-1α-422 21 nt Targ: | 5'-CGATTCACCATGGAGGGCGCC-3' | (SEQ ID NO: 4219) |
| HIF-1α-427 21 nt Targ: | 5'-CACCATGGAGGGCGCCGGCGG-3' | (SEQ ID NO: 4220) |
| HIF-1α-429 21 nt Targ: | 5'-CCATGGAGGGCGCCGGCGGCG-3' | (SEQ ID NO: 4221) |
| HIF-1α-448 21 nt Targ: | 5'-CGCGAACGACAAGAAAAAGAT-3' | (SEQ ID NO: 4222) |
| HIF-1α-455 21 nt Targ: | 5'-GACAAGAAAAAGATAAGTTCT-3' | (SEQ ID NO: 4223) |
| HIF-1α-469 21 nt Targ: | 5'-AAGTTCTGAACGTCGAAAAGA-3' | (SEQ ID NO: 4224) |
| HIF-1α-471 21 nt Targ: | 5'-GTTCTGAACGTCGAAAAGAAA-3' | (SEQ ID NO: 4225) |
| HIF-1α-473 21 nt Targ: | 5'-TCTGAACGTCGAAAAGAAAAG-3' | (SEQ ID NO: 4226) |
| HIF-1α-475 21 nt Targ: | 5'-TGAACGTCGAAAAGAAAAGTC-3' | (SEQ ID NO: 4227) |
| HIF-1α-525 21 nt Targ: | 5'-AAGAATCTGAAGTTTTTATG-3' | (SEQ ID NO: 4228) |
| HIF-1α-528 21 nt Targ: | 5'-AATCTGAAGTTTTTATGAGC-3' | (SEQ ID NO: 4229) |
| HIF-1α-530 21 nt Targ: | 5'-TCTGAAGTTTTTATGAGCTT-3' | (SEQ ID NO: 4230) |
| HIF-1α-532 21 nt Targ: | 5'-TGAAGTTTTTATGAGCTTGC-3' | (SEQ ID NO: 4231) |
| HIF-1α-534 21 nt Targ: | 5'-AAGTTTTTATGAGCTTGCTC-3' | (SEQ ID NO: 4232) |
| HIF-1α-536 21 nt Targ: | 5'-GTTTTTATGAGCTTGCTCAT-3' | (SEQ ID NO: 4233) |
| HIF-1α-538 21 nt Targ: | 5'-TTTTTATGAGCTTGCTCATCA-3' | (SEQ ID NO: 4234) |
| HIF-1α-540 21 nt Targ: | 5'-TTTATGAGCTTGCTCATCAGT-3' | (SEQ ID NO: 4235) |

TABLE 5-continued

| DsiRNA Target Sequences (21mers) In HIF-1α mRNA | | |
|---|---|---|
| HIF-1α-542 21 nt Targ: | 5'-TATGAGCTTGCTCATCAGTTG-3' | (SEQ ID NO: 4236) |
| HIF-1α-544 21 nt Targ: | 5'-TGAGCTTGCTCATCAGTTGCC-3' | (SEQ ID NO: 4237) |
| HIF-1α-546 21 nt Targ: | 5'-AGCTTGCTCATCAGTTGCCAC-3' | (SEQ ID NO: 4238) |
| HIF-1α-548 21 nt Targ: | 5'-CTTGCTCATCAGTTGCCACTT-3' | (SEQ ID NO: 4239) |
| HIF-1α-550 21 nt Targ: | 5'-TGCTCATCAGTTGCCACTTCC-3' | (SEQ ID NO: 4240) |
| HIF-1α-562 21 nt Targ: | 5'-GCCACTTCCACATAATGTGAG-3' | (SEQ ID NO: 4241) |
| HIF-1α-642 21 nt Targ: | 5'-AACTTCTGGATGCTGGTGATT-3' | (SEQ ID NO: 4242) |
| HIF-1α-644 21 nt Targ: | 5'-CTTCTGGATGCTGGTGATTTG-3' | (SEQ ID NO: 4243) |
| HIF-1α-645 21 nt Targ: | 5'-TTCTGGATGCTGGTGATTTGG-3' | (SEQ ID NO: 4244) |
| HIF-1α-665 21 nt Targ: | 5'-GATATTGAAGATGACATGAAA-3' | (SEQ ID NO: 4245) |
| HIF-1α-691 21 nt Targ: | 5'-GATGAATTGCTTTTATTTGAA-3' | (SEQ ID NO: 4246) |
| HIF-1α-707 21 nt Targ: | 5'-TTGAAAGCCTTGGATGGTTTT-3' | (SEQ ID NO: 4247) |
| HIF-1α-711 21 nt Targ: | 5'-AAGCCTTGGATGGTTTTGTTA-3' | (SEQ ID NO: 4248) |
| HIF-1α-713 21 nt Targ: | 5'-GCCTTGGATGGTTTTGTTATG-3' | (SEQ ID NO: 4249) |
| HIF-1α-715 21 nt Targ: | 5'-CTTGGATGGTTTTGTTATGGT-3' | (SEQ ID NO: 4250) |
| HIF-1α-717 21 nt Targ: | 5'-TGGATGGTTTTGTTATGGTTC-3' | (SEQ ID NO: 4251) |
| HIF-1α-756 21 nt Targ: | 5'-TGATTTACATTTCTGATAATG-3' | (SEQ ID NO: 4252) |
| HIF-1α-790 21 nt Targ: | 5'-GGGATTAACTCAGTTTGAACT-3' | (SEQ ID NO: 4253) |
| HIF-1α-793 21 nt Targ: | 5'-ATTAACTCAGTTTGAACTAAC-3' | (SEQ ID NO: 4254) |
| HIF-1α-824 21 nt Targ: | 5'-GTGTTTGATTTTACTCATCCA-3' | (SEQ ID NO: 4255) |
| HIF-1α-826 21 nt Targ: | 5'-GTTTGATTTTACTCATCCATG-3' | (SEQ ID NO: 4256) |
| HIF-1α-828 21 nt Targ: | 5'-TTGATTTTACTCATCCATGTG-3' | (SEQ ID NO: 4257) |
| HIF-1α-830 21 nt Targ: | 5'-GATTTTACTCATCCATGTGAC-3' | (SEQ ID NO: 4258) |
| HIF-1α-832 21 nt Targ: | 5'-TTTTACTCATCCATGTGACCA-3' | (SEQ ID NO: 4259) |
| HIF-1α-834 21 nt Targ: | 5'-TTACTCATCCATGTGACCATG-3' | (SEQ ID NO: 4260) |
| HIF-1α-836 21 nt Targ: | 5'-ACTCATCCATGTGACCATGAG-3' | (SEQ ID NO: 4261) |
| HIF-1α-838 21 nt Targ: | 5'-TCATCCATGTGACCATGAGGA-3' | (SEQ ID NO: 4262) |
| HIF-1α-840 21 nt Targ: | 5'-ATCCATGTGACCATGAGGAAA-3' | (SEQ ID NO: 4263) |
| HIF-1α-842 21 nt Targ: | 5'-CCATGTGACCATGAGGAAATG-3' | (SEQ ID NO: 4264) |
| HIF-1α-844 21 nt Targ: | 5'-ATGTGACCATGAGGAAATGAG-3' | (SEQ ID NO: 4265) |
| HIF-1α-846 21 nt Targ: | 5'-GTGACCATGAGGAAATGAGAG-3' | (SEQ ID NO: 4266) |
| HIF-1α-848 21 nt Targ: | 5'-GACCATGAGGAAATGAGAGAA-3' | (SEQ ID NO: 4267) |
| HIF-1α-850 21 nt Targ: | 5'-CCATGAGGAAATGAGAGAAAT-3' | (SEQ ID NO: 4268) |
| HIF-1α-852 21 nt Targ: | 5'-ATGAGGAAATGAGAGAAATGC-3' | (SEQ ID NO: 4269) |
| HIF-1α-921 21 nt Targ: | 5'-AGCGAAGCTTTTTCTCAGAA-3' | (SEQ ID NO: 4270) |
| HIF-1α-925 21 nt Targ: | 5'-AAGCTTTTTCTCAGAATGAA-3' | (SEQ ID NO: 4271) |
| HIF-1α-927 21 nt Targ: | 5'-GCTTTTTCTCAGAATGAAGT-3' | (SEQ ID NO: 4272) |
| HIF-1α-1029 21 nt Targ: | 5'-TATATGATACCAACAGTAACC-3' | (SEQ ID NO: 4273) |
| HIF-1α-1031 21 nt Targ: | 5'-TATGATACCAACAGTAACCAA-3' | (SEQ ID NO: 4274) |

TABLE 5-continued

DsiRNA Target Sequences (21mers) In HIF-1α mRNA

| | | | |
|---|---|---|---|
| HIF-1α-1033 21 nt Targ: | 5'-TGATACCAACAGTAACCAACC-3' | (SEQ ID NO: 4275) |
| HIF-1α-1035 21 nt Targ: | 5'-ATACCAACAGTAACCAACCTC-3' | (SEQ ID NO: 4276) |
| HIF-1α-1037 21 nt Targ: | 5'-ACCAACAGTAACCAACCTCAG-3' | (SEQ ID NO: 4277) |
| HIF-1α-1039 21 nt Targ: | 5'-CAACAGTAACCAACCTCAGTG-3' | (SEQ ID NO: 4278) |
| HIF-1α-1041 21 nt Targ: | 5'-ACAGTAACCAACCTCAGTGTG-3' | (SEQ ID NO: 4279) |
| HIF-1α-1043 21 nt Targ: | 5'-AGTAACCAACCTCAGTGTGGG-3' | (SEQ ID NO: 4280) |
| HIF-1α-1045 21 nt Targ: | 5'-TAACCAACCTCAGTGTGGGTA-3' | (SEQ ID NO: 4281) |
| HIF-1α-1074 21 nt Targ: | 5'-CACCTATGACCTGCTTGGTGC-3' | (SEQ ID NO: 4282) |
| HIF-1α-1075 21 nt Targ: | 5'-ACCTATGACCTGCTTGGTGCT-3' | (SEQ ID NO: 4283) |
| HIF-1α-1077 21 nt Targ: | 5'-CTATGACCTGCTTGGTGCTGA-3' | (SEQ ID NO: 4284) |
| HIF-1α-1084 21 nt Targ: | 5'-CTGCTTGGTGCTGATTTGTGA-3' | (SEQ ID NO: 4285) |
| HIF-1α-1086 21 nt Targ: | 5'-GCTTGGTGCTGATTTGTGAAC-3' | (SEQ ID NO: 4286) |
| HIF-1α-1088 21 nt Targ: | 5'-TTGGTGCTGATTTGTGAACCC-3' | (SEQ ID NO: 4287) |
| HIF-1α-1090 21 nt Targ: | 5'-GGTGCTGATTTGTGAACCCAT-3' | (SEQ ID NO: 4288) |
| HIF-1α-1092 21 nt Targ: | 5'-TGCTGATTTGTGAACCCATTC-3' | (SEQ ID NO: 4289) |
| HIF-1α-1094 21 nt Targ: | 5'-CTGATTTGTGAACCCATTCCT-3' | (SEQ ID NO: 4290) |
| HIF-1α-1096 21 nt Targ: | 5'-GATTTGTGAACCCATTCCTCA-3' | (SEQ ID NO: 4291) |
| HIF-1α-1120 21 nt Targ: | 5'-ATCAAATATTGAAATTCCTTT-3' | (SEQ ID NO: 4292) |
| HIF-1α-1122 21 nt Targ: | 5'-CAAATATTGAAATTCCTTTAG-3' | (SEQ ID NO: 4293) |
| HIF-1α-1124 21 nt Targ: | 5'-AATATTGAAATTCCTTTAGAT-3' | (SEQ ID NO: 4294) |
| HIF-1α-1126 21 nt Targ: | 5'-TATTGAAATTCCTTTAGATAG-3' | (SEQ ID NO: 4295) |
| HIF-1α-1128 21 nt Targ: | 5'-TTGAAATTCCTTTAGATAGCA-3' | (SEQ ID NO: 4296) |
| HIF-1α-1130 21 nt Targ: | 5'-GAAATTCCTTTAGATAGCAAG-3' | (SEQ ID NO: 4297) |
| HIF-1α-1132 21 nt Targ: | 5'-AATTCCTTTAGATAGCAAGAC-3' | (SEQ ID NO: 4298) |
| HIF-1α-1166 21 nt Targ: | 5'-CACAGCCTGGATATGAAATTT-3' | (SEQ ID NO: 4299) |
| HIF-1α-1174 21 nt Targ: | 5'-GGATATGAAATTTTCTTATTG-3' | (SEQ ID NO: 4300) |
| HIF-1α-1243 21 nt Targ: | 5'-AGGCCGCTCAATTTATGAATA-3' | (SEQ ID NO: 4301) |
| HIF-1α-1245 21 nt Targ: | 5'-GCCGCTCAATTTATGAATATT-3' | (SEQ ID NO: 4302) |
| HIF-1α-1247 21 nt Targ: | 5'-CGCTCAATTTATGAATATTAT-3' | (SEQ ID NO: 4303) |
| HIF-1α-1249 21 nt Targ: | 5'-CTCAATTTATGAATATTATCA-3' | (SEQ ID NO: 4304) |
| HIF-1α-1251 21 nt Targ: | 5'-CAATTTATGAATATTATCATG-3' | (SEQ ID NO: 4305) |
| HIF-1α-1253 21 nt Targ: | 5'-ATTTATGAATATTATCATGCT-3' | (SEQ ID NO: 4306) |
| HIF-1α-1255 21 nt Targ: | 5'-TTATGAATATTATCATGCTTT-3' | (SEQ ID NO: 4307) |
| HIF-1α-1257 21 nt Targ: | 5'-ATGAATATTATCATGCTTTGG-3' | (SEQ ID NO: 4308) |
| HIF-1α-1262 21 nt Targ: | 5'-TATTATCATGCTTTGGACTCT-3' | (SEQ ID NO: 4309) |
| HIF-1α-1265 21 nt Targ: | 5'-TATCATGCTTTGGACTCTGAT-3' | (SEQ ID NO: 4310) |
| HIF-1α-1268 21 nt Targ: | 5'-CATGCTTTGGACTCTGATCAT-3' | (SEQ ID NO: 4311) |
| HIF-1α-1271 21 nt Targ: | 5'-GCTTTGGACTCTGATCATCTG-3' | (SEQ ID NO: 4312) |
| HIF-1α-1278 21 nt Targ: | 5'-ACTCTGATCATCTGACCAAAA-3' | (SEQ ID NO: 4313) |

TABLE 5-continued

DsiRNA Target Sequences (21mers) In HIF-1α mRNA

| | | |
|---|---|---|
| HIF-1α-1280 21 nt Targ: | 5'-TCTGATCATCTGACCAAAACT-3' | (SEQ ID NO: 4314) |
| HIF-1α-1282 21 nt Targ: | 5'-TGATCATCTGACCAAAACTCA-3' | (SEQ ID NO: 4315) |
| HIF-1α-1303 21 nt Targ: | 5'-TCATGATATGTTTACTAAAGG-3' | (SEQ ID NO: 4316) |
| HIF-1α-1305 21 nt Targ: | 5'-ATGATATGTTTACTAAAGGAC-3' | (SEQ ID NO: 4317) |
| HIF-1α-1307 21 nt Targ: | 5'-GATATGTTTACTAAAGGACAA-3' | (SEQ ID NO: 4318) |
| HIF-1α-1309 21 nt Targ: | 5'-TATGTTTACTAAAGGACAAGT-3' | (SEQ ID NO: 4319) |
| HIF-1α-1311 21 nt Targ: | 5'-TGTTTACTAAAGGACAAGTCA-3' | (SEQ ID NO: 4320) |
| HIF-1α-1313 21 nt Targ: | 5'-TTTACTAAAGGACAAGTCACC-3' | (SEQ ID NO: 4321) |
| HIF-1α-1315 21 nt Targ: | 5'-TACTAAAGGACAAGTCACCAC-3' | (SEQ ID NO: 4322) |
| HIF-1α-1317 21 nt Targ: | 5'-CTAAAGGACAAGTCACCACAG-3' | (SEQ ID NO: 4323) |
| HIF-1α-1319 21 nt Targ: | 5'-AAAGGACAAGTCACCACAGGA-3' | (SEQ ID NO: 4324) |
| HIF-1α-1321 21 nt Targ: | 5'-AGGACAAGTCACCACAGGACA-3' | (SEQ ID NO: 4325) |
| HIF-1α-1323 21 nt Targ: | 5'-GACAAGTCACCACAGGACAGT-3' | (SEQ ID NO: 4326) |
| HIF-1α-1325 21 nt Targ: | 5'-CAAGTCACCACAGGACAGTAC-3' | (SEQ ID NO: 4327) |
| HIF-1α-1327 21 nt Targ: | 5'-AGTCACCACAGGACAGTACAG-3' | (SEQ ID NO: 4328) |
| HIF-1α-1329 21 nt Targ: | 5'-TCACCACAGGACAGTACAGGA-3' | (SEQ ID NO: 4329) |
| HIF-1α-1331 21 nt Targ: | 5'-ACCACAGGACAGTACAGGATG-3' | (SEQ ID NO: 4330) |
| HIF-1α-1333 21 nt Targ: | 5'-CACAGGACAGTACAGGATGCT-3' | (SEQ ID NO: 4331) |
| HIF-1α-1335 21 nt Targ: | 5'-CAGGACAGTACAGGATGCTTG-3' | (SEQ ID NO: 4332) |
| HIF-1α-1337 21 nt Targ: | 5'-GGACAGTACAGGATGCTTGCC-3' | (SEQ ID NO: 4333) |
| HIF-1α-1339 21 nt Targ: | 5'-ACAGTACAGGATGCTTGCCAA-3' | (SEQ ID NO: 4334) |
| HIF-1α-1341 21 nt Targ: | 5'-AGTACAGGATGCTTGCCAAAA-3' | (SEQ ID NO: 4335) |
| HIF-1α-1343 21 nt Targ: | 5'-TACAGGATGCTTGCCAAAAGA-3' | (SEQ ID NO: 4336) |
| HIF-1α-1345 21 nt Targ: | 5'-CAGGATGCTTGCCAAAAGAGG-3' | (SEQ ID NO: 4337) |
| HIF-1α-1347 21 nt Targ: | 5'-GGATGCTTGCCAAAAGAGGTG-3' | (SEQ ID NO: 4338) |
| HIF-1α-1349 21 nt Targ: | 5'-ATGCTTGCCAAAAGAGGTGGA-3' | (SEQ ID NO: 4339) |
| HIF-1α-1351 21 nt Targ: | 5'-GCTTGCCAAAAGAGGTGGATA-3' | (SEQ ID NO: 4340) |
| HIF-1α-1353 21 nt Targ: | 5'-TTGCCAAAAGAGGTGGATATG-3' | (SEQ ID NO: 4341) |
| HIF-1α-1355 21 nt Targ: | 5'-GCCAAAAGAGGTGGATATGTC-3' | (SEQ ID NO: 4342) |
| HIF-1α-1357 21 nt Targ: | 5'-CAAAAGAGGTGGATATGTCTG-3' | (SEQ ID NO: 4343) |
| HIF-1α-1359 21 nt Targ: | 5'-AAAGAGGTGGATATGTCTGGG-3' | (SEQ ID NO: 4344) |
| HIF-1α-1361 21 nt Targ: | 5'-AGAGGTGGATATGTCTGGGTT-3' | (SEQ ID NO: 4345) |
| HIF-1α-1363 21 nt Targ: | 5'-AGGTGGATATGTCTGGGTTGA-3' | (SEQ ID NO: 4346) |
| HIF-1α-1365 21 nt Targ: | 5'-GTGGATATGTCTGGGTTGAAA-3' | (SEQ ID NO: 4347) |
| HIF-1α-1367 21 nt Targ: | 5'-GGATATGTCTGGGTTGAAACT-3' | (SEQ ID NO: 4348) |
| HIF-1α-1369 21 nt Targ: | 5'-ATATGTCTGGGTTGAAACTCA-3' | (SEQ ID NO: 4349) |
| HIF-1α-1371 21 nt Targ: | 5'-ATGTCTGGGTTGAAACTCAAG-3' | (SEQ ID NO: 4350) |
| HIF-1α-1373 21 nt Targ: | 5'-GTCTGGGTTGAAACTCAAGCA-3' | (SEQ ID NO: 4351) |
| HIF-1α-1375 21 nt Targ: | 5'-CTGGGTTGAAACTCAAGCAAC-3' | (SEQ ID NO: 4352) |

TABLE 5-continued

DsiRNA Target Sequences (21mers) In HIF-1α mRNA

| | | |
|---|---|---|
| HIF-1α-1377 21 nt Targ: | 5'-GGGTTGAAACTCAAGCAACTG-3' | (SEQ ID NO: 4353) |
| HIF-1α-1379 21 nt Targ: | 5'-GTTGAAACTCAAGCAACTGTC-3' | (SEQ ID NO: 4354) |
| HIF-1α-1381 21 nt Targ: | 5'-TGAAACTCAAGCAACTGTCAT-3' | (SEQ ID NO: 4355) |
| HIF-1α-1383 21 nt Targ: | 5'-AAACTCAAGCAACTGTCATAT-3' | (SEQ ID NO: 4356) |
| HIF-1α-1385 21 nt Targ: | 5'-ACTCAAGCAACTGTCATATAT-3' | (SEQ ID NO: 4357) |
| HIF-1α-1387 21 nt Targ: | 5'-TCAAGCAACTGTCATATATAA-3' | (SEQ ID NO: 4358) |
| HIF-1α-1456 21 nt Targ: | 5'-GAGTGGTATTATTCAGCACGA-3' | (SEQ ID NO: 4359) |
| HIF-1α-1458 21 nt Targ: | 5'-GTGGTATTATTCAGCACGACT-3' | (SEQ ID NO: 4360) |
| HIF-1α-1460 21 nt Targ: | 5'-GGTATTATTCAGCACGACTTG-3' | (SEQ ID NO: 4361) |
| HIF-1α-1462 21 nt Targ: | 5'-TATTATTCAGCACGACTTGAT-3' | (SEQ ID NO: 4362) |
| HIF-1α-1464 21 nt Targ: | 5'-TTATTCAGCACGACTTGATTT-3' | (SEQ ID NO: 4363) |
| HIF-1α-1466 21 nt Targ: | 5'-ATTCAGCACGACTTGATTTTC-3' | (SEQ ID NO: 4364) |
| HIF-1α-1468 21 nt Targ: | 5'-TCAGCACGACTTGATTTTCTC-3' | (SEQ ID NO: 4365) |
| HIF-1α-1470 21 nt Targ: | 5'-AGCACGACTTGATTTTCTCCC-3' | (SEQ ID NO: 4366) |
| HIF-1α-1472 21 nt Targ: | 5'-CACGACTTGATTTTCTCCCTT-3' | (SEQ ID NO: 4367) |
| HIF-1α-1474 21 nt Targ: | 5'-CGACTTGATTTTCTCCCTTCA-3' | (SEQ ID NO: 4368) |
| HIF-1α-1476 21 nt Targ: | 5'-ACTTGATTTTCTCCCTTCAAC-3' | (SEQ ID NO: 4369) |
| HIF-1α-1478 21 nt Targ: | 5'-TTGATTTTCTCCCTTCAACAA-3' | (SEQ ID NO: 4370) |
| HIF-1α-1480 21 nt Targ: | 5'-GATTTTCTCCCTTCAACAAAC-3' | (SEQ ID NO: 4371) |
| HIF-1α-1482 21 nt Targ: | 5'-TTTTCTCCCTTCAACAAACAG-3' | (SEQ ID NO: 4372) |
| HIF-1α-1519 21 nt Targ: | 5'-GGTTGAATCTTCAGATATGAA-3' | (SEQ ID NO: 4373) |
| HIF-1α-1552 21 nt Targ: | 5'-ATTCACCAAAGTTGAATCAGA-3' | (SEQ ID NO: 4374) |
| HIF-1α-1572 21 nt Targ: | 5'-AAGATACAAGTAGCCTCTTTG-3' | (SEQ ID NO: 4375) |
| HIF-1α-1648 21 nt Targ: | 5'-CACAATCATATCTTTAGATTT-3' | (SEQ ID NO: 4376) |
| HIF-1α-1709 21 nt Targ: | 5'-GAAGTACCATTATATAATGAT-3' | (SEQ ID NO: 4377) |
| HIF-1α-1714 21 nt Targ: | 5'-ACCATTATATAATGATGTAAT-3' | (SEQ ID NO: 4378) |
| HIF-1α-1786 21 nt Targ: | 5'-ATTACCCACCGCTGAAACGCC-3' | (SEQ ID NO: 4379) |
| HIF-1α-1804 21 nt Targ: | 5'-GCCAAAGCCACTTCGAAGTAG-3' | (SEQ ID NO: 4380) |
| HIF-1α-1806 21 nt Targ: | 5'-CAAAGCCACTTCGAAGTAGTG-3' | (SEQ ID NO: 4381) |
| HIF-1α-1808 21 nt Targ: | 5'-AAGCCACTTCGAAGTAGTGCT-3' | (SEQ ID NO: 4382) |
| HIF-1α-1810 21 nt Targ: | 5'-GCCACTTCGAAGTAGTGCTGA-3' | (SEQ ID NO: 4383) |
| HIF-1α-1814 21 nt Targ: | 5'-CTTCGAAGTAGTGCTGACCCT-3' | (SEQ ID NO: 4384) |
| HIF-1α-1845 21 nt Targ: | 5'-AAGAAGTTGCATTAAAATTAG-3' | (SEQ ID NO: 4385) |
| HIF-1α-1936 21 nt Targ: | 5'-CGATGGAAGCACTAGACAAAG-3' | (SEQ ID NO: 4386) |
| HIF-1α-1938 21 nt Targ: | 5'-ATGGAAGCACTAGACAAAGTT-3' | (SEQ ID NO: 4387) |
| HIF-1α-1940 21 nt Targ: | 5'-GGAAGCACTAGACAAAGTTCA-3' | (SEQ ID NO: 4388) |
| HIF-1α-1942 21 nt Targ: | 5'-AAGCACTAGACAAAGTTCACC-3' | (SEQ ID NO: 4389) |
| HIF-1α-1944 21 nt Targ: | 5'-GCACTAGACAAAGTTCACCTG-3' | (SEQ ID NO: 4390) |
| HIF-1α-1946 21 nt Targ: | 5'-ACTAGACAAAGTTCACCTGAG-3' | (SEQ ID NO: 4391) |

TABLE 5-continued

DsiRNA Target Sequences (21mers) In HIF-1α mRNA

| | | | |
|---|---|---|---|
| HIF-1α-1977 21 nt Targ: | 5'-CCAGTGAATATTGTTTTATG-3' | (SEQ ID NO: 4392) |
| HIF-1α-1985 21 nt Targ: | 5'-TATTGTTTTATGTGGATAGT-3' | (SEQ ID NO: 4393) |
| HIF-1α-2034 21 nt Targ: | 5'-TGGTAGAAAAACTTTTTGCTG-3' | (SEQ ID NO: 4394) |
| HIF-1α-2116 21 nt Targ: | 5'-AGCTCCCTATATCCCAATGGA-3' | (SEQ ID NO: 4395) |
| HIF-1α-2118 21 nt Targ: | 5'-CTCCCTATATCCCAATGGATG-3' | (SEQ ID NO: 4396) |
| HIF-1α-2120 21 nt Targ: | 5'-CCCTATATCCCAATGGATGAT-3' | (SEQ ID NO: 4397) |
| HIF-1α-2122 21 nt Targ: | 5'-CTATATCCCAATGGATGATGA-3' | (SEQ ID NO: 4398) |
| HIF-1α-2161 21 nt Targ: | 5'-CGATCAGTTGTCACCATTAGA-3' | (SEQ ID NO: 4399) |
| HIF-1α-2185 21 nt Targ: | 5'-CAGTTCCGCAAGCCCTGAAAG-3' | (SEQ ID NO: 4400) |
| HIF-1α-2187 21 nt Targ: | 5'-GTTCCGCAAGCCCTGAAAGCG-3' | (SEQ ID NO: 4401) |
| HIF-1α-2290 21 nt Targ: | 5'-CACTGATGAATTAAAAACAGT-3' | (SEQ ID NO: 4402) |
| HIF-1α-2326 21 nt Targ: | 5'-GGAAGACATTAAAATATTGAT-3' | (SEQ ID NO: 4403) |
| HIF-1α-2452 21 nt Targ: | 5'-AGGAGTCATAGAACAGACAGA-3' | (SEQ ID NO: 4404) |
| HIF-1α-2555 21 nt Targ: | 5'-AAGATACTAGCTTTGCAGAAT-3' | (SEQ ID NO: 4405) |
| HIF-1α-2577 21 nt Targ: | 5'-CTCAGAGAAAGCGAAAAATGG-3' | (SEQ ID NO: 4406) |
| HIF-1α-2584 21 nt Targ: | 5'-AAAGCGAAAAATGGAACATGA-3' | (SEQ ID NO: 4407) |
| HIF-1α-2586 21 nt Targ: | 5'-AGCGAAAAATGGAACATGATG-3' | (SEQ ID NO: 4408) |
| HIF-1α-2618 21 nt Targ: | 5'-CAAGCAGTAGGAATTGGAACA-3' | (SEQ ID NO: 4409) |
| HIF-1α-2705 21 nt Targ: | 5'-AAATCTAGTGAACAGAATGGA-3' | (SEQ ID NO: 4410) |
| HIF-1α-2730 21 nt Targ: | 5'-AGCAAAAGACAATTATTTTAA-3' | (SEQ ID NO: 4411) |
| HIF-1α-2796 21 nt Targ: | 5'-AAAGTGGATTACCACAGCTGA-3' | (SEQ ID NO: 4412) |
| HIF-1α-2798 21 nt Targ: | 5'-AGTGGATTACCACAGCTGACC-3' | (SEQ ID NO: 4413) |
| HIF-1α-2800 21 nt Targ: | 5'-TGGATTACCACAGCTGACCAG-3' | (SEQ ID NO: 4414) |
| HIF-1α-2802 21 nt Targ: | 5'-GATTACCACAGCTGACCAGTT-3' | (SEQ ID NO: 4415) |
| HIF-1α-2823 21 nt Targ: | 5'-ATGATTGTGAAGTTAATGCTC-3' | (SEQ ID NO: 4416) |
| HIF-1α-2844 21 nt Targ: | 5'-CTATACAAGGCAGCAGAAACC-3' | (SEQ ID NO: 4417) |
| HIF-1α-2846 21 nt Targ: | 5'-ATACAAGGCAGCAGAAACCTA-3' | (SEQ ID NO: 4418) |
| HIF-1α-2848 21 nt Targ: | 5'-ACAAGGCAGCAGAAACCTACT-3' | (SEQ ID NO: 4419) |
| HIF-1α-2850 21 nt Targ: | 5'-AAGGCAGCAGAAACCTACTGC-3' | (SEQ ID NO: 4420) |
| HIF-1α-2852 21 nt Targ: | 5'-GGCAGCAGAAACCTACTGCAG-3' | (SEQ ID NO: 4421) |
| HIF-1α-2854 21 nt Targ: | 5'-CAGCAGAAACCTACTGCAGGG-3' | (SEQ ID NO: 4422) |
| HIF-1α-2856 21 nt Targ: | 5'-GCAGAAACCTACTGCAGGGTG-3' | (SEQ ID NO: 4423) |
| HIF-1α-2858 21 nt Targ: | 5'-AGAAACCTACTGCAGGGTGAA-3' | (SEQ ID NO: 4424) |
| HIF-1α-2860 21 nt Targ: | 5'-AAACCTACTGCAGGGTGAAGA-3' | (SEQ ID NO: 4425) |
| HIF-1α-2862 21 nt Targ: | 5'-ACCTACTGCAGGGTGAAGAAT-3' | (SEQ ID NO: 4426) |
| HIF-1α-2864 21 nt Targ: | 5'-CTACTGCAGGGTGAAGAATTA-3' | (SEQ ID NO: 4427) |
| HIF-1α-2866 21 nt Targ: | 5'-ACTGCAGGGTGAAGAATTACT-3' | (SEQ ID NO: 4428) |
| HIF-1α-2868 21 nt Targ: | 5'-TGCAGGGTGAAGAATTACTCA-3' | (SEQ ID NO: 4429) |
| HIF-1α-2870 21 nt Targ: | 5'-CAGGGTGAAGAATTACTCAGA-3' | (SEQ ID NO: 4430) |

TABLE 5-continued

DsiRNA Target Sequences (21mers) In HIF-1α mRNA

| | | |
|---|---|---|
| HIF-1α-2872 21 nt Targ: | 5'-GGGTGAAGAATTACTCAGAGC-3' | (SEQ ID NO: 4431) |
| HIF-1α-2874 21 nt Targ: | 5'-GTGAAGAATTACTCAGAGCTT-3' | (SEQ ID NO: 4432) |
| HIF-1α-2876 21 nt Targ: | 5'-GAAGAATTACTCAGAGCTTTG-3' | (SEQ ID NO: 4433) |
| HIF-1α-2878 21 nt Targ: | 5'-AGAATTACTCAGAGCTTTGGA-3' | (SEQ ID NO: 4434) |
| HIF-1α-2880 21 nt Targ: | 5'-AATTACTCAGAGCTTTGGATC-3' | (SEQ ID NO: 4435) |
| HIF-1α-2882 21 nt Targ: | 5'-TTACTCAGAGCTTTGGATCAA-3' | (SEQ ID NO: 4436) |
| HIF-1α-2884 21 nt Targ: | 5'-ACTCAGAGCTTTGGATCAAGT-3' | (SEQ ID NO: 4437) |
| HIF-1α-2886 21 nt Targ: | 5'-TCAGAGCTTTGGATCAAGTTA-3' | (SEQ ID NO: 4438) |
| HIF-1α-2888 21 nt Targ: | 5'-AGAGCTTTGGATCAAGTTAAC-3' | (SEQ ID NO: 4439) |
| HIF-1α-2890 21 nt Targ: | 5'-AGCTTTGGATCAAGTTAACTG-3' | (SEQ ID NO: 4440) |
| HIF-1α-2892 21 nt Targ: | 5'-CTTTGGATCAAGTTAACTGAG-3' | (SEQ ID NO: 4441) |
| HIF-1α-2895 21 nt Targ: | 5'-TGGATCAAGTTAACTGAGCTT-3' | (SEQ ID NO: 4442) |
| HIF-1α-2906 21 nt Targ: | 5'-AACTGAGCTTTTCTTAATTT-3' | (SEQ ID NO: 4443) |
| HIF-1α-2910 21 nt Targ: | 5'-GAGCTTTTCTTAATTTCATT-3' | (SEQ ID NO: 4444) |
| HIF-1α-2919 21 nt Targ: | 5'-CTTAATTTCATTCCTTTTTT-3' | (SEQ ID NO: 4445) |
| HIF-1α-2925 21 nt Targ: | 5'-TTCATTCCTTTTTTGGACAC-3' | (SEQ ID NO: 4446) |
| HIF-1α-2933 21 nt Targ: | 5'-TTTTTTTGGACACTGGTGGCT-3' | (SEQ ID NO: 4447) |
| HIF-1α-2935 21 nt Targ: | 5'-TTTTTGGACACTGGTGGCTCA-3' | (SEQ ID NO: 4448) |
| HIF-1α-2963 21 nt Targ: | 5'-AAGCAGTCTATTTATATTTTC-3' | (SEQ ID NO: 4449) |
| HIF-1α-2965 21 nt Targ: | 5'-GCAGTCTATTTATATTTTCTA-3' | (SEQ ID NO: 4450) |
| HIF-1α-2970 21 nt Targ: | 5'-CTATTTATATTTTCTACATCT-3' | (SEQ ID NO: 4451) |
| HIF-1α-2986 21 nt Targ: | 5'-CATCTAATTTTAGAAGCCTGG-3' | (SEQ ID NO: 4452) |
| HIF-1α-2988 21 nt Targ: | 5'-TCTAATTTTAGAAGCCTGGCT-3' | (SEQ ID NO: 4453) |
| HIF-1α-2990 21 nt Targ: | 5'-TAATTTTAGAAGCCTGGCTAC-3' | (SEQ ID NO: 4454) |
| HIF-1α-2992 21 nt Targ: | 5'-ATTTTAGAAGCCTGGCTACAA-3' | (SEQ ID NO: 4455) |
| HIF-1α-2994 21 nt Targ: | 5'-TTTAGAAGCCTGGCTACAATA-3' | (SEQ ID NO: 4456) |
| HIF-1α-2996 21 nt Targ: | 5'-TAGAAGCCTGGCTACAATACT-3' | (SEQ ID NO: 4457) |
| HIF-1α-2998 21 nt Targ: | 5'-GAAGCCTGGCTACAATACTGC-3' | (SEQ ID NO: 4458) |
| HIF-1α-3000 21 nt Targ: | 5'-AGCCTGGCTACAATACTGCAC-3' | (SEQ ID NO: 4459) |
| HIF-1α-3002 21 nt Targ: | 5'-CCTGGCTACAATACTGCACAA-3' | (SEQ ID NO: 4460) |
| HIF-1α-3004 21 nt Targ: | 5'-TGGCTACAATACTGCACAAAC-3' | (SEQ ID NO: 4461) |
| HIF-1α-3055 21 nt Targ: | 5'-CTTAATTTACATTAATGCTCT-3' | (SEQ ID NO: 4462) |
| HIF-1α-3065 21 nt Targ: | 5'-ATTAATGCTCTTTTTTAGTAT-3' | (SEQ ID NO: 4463) |
| HIF-1α-3067 21 nt Targ: | 5'-TAATGCTCTTTTTTAGTATGT-3' | (SEQ ID NO: 4464) |
| HIF-1α-3068 21 nt Targ: | 5'-AATGCTCTTTTTTAGTATGTT-3' | (SEQ ID NO: 4465) |
| HIF-1α-3077 21 nt Targ: | 5'-TTTTAGTATGTTCTTTAATGC-3' | (SEQ ID NO: 4466) |
| HIF-1α-3081 21 nt Targ: | 5'-AGTATGTTCTTTAATGCTGGA-3' | (SEQ ID NO: 4467) |
| HIF-1α-3088 21 nt Targ: | 5'-TCTTTAATGCTGGATCACAGA-3' | (SEQ ID NO: 4468) |
| HIF-1α-3093 21 nt Targ: | 5'-AATGCTGGATCACAGACAGCT-3' | (SEQ ID NO: 4469) |

TABLE 5-continued

DsiRNA Target Sequences (21mers) In HIF-1α mRNA

| | | | |
|---|---|---|---|
| HIF-1α-3110 21 nt Targ: | 5'-AGCTCATTTCTCAGTTTTTT-3' | (SEQ ID NO: 4470) |
| HIF-1α-3167 21 nt Targ: | 5'-AAAAAATGCACCTTTTTATTT-3' | (SEQ ID NO: 4471) |
| HIF-1α-3169 21 nt Targ: | 5'-AAAATGCACCTTTTTATTTAT-3' | (SEQ ID NO: 4472) |
| HIF-1α-3171 21 nt Targ: | 5'-AATGCACCTTTTTATTTATTT-3' | (SEQ ID NO: 4473) |
| HIF-1α-3173 21 nt Targ: | 5'-TGCACCTTTTTATTTATTTAT-3' | (SEQ ID NO: 4474) |
| HIF-1α-3175 21 nt Targ: | 5'-CACCTTTTTATTTATTTATTT-3' | (SEQ ID NO: 4475) |
| HIF-1α-3177 21 nt Targ: | 5'-CCTTTTTATTTATTTATTTTT-3' | (SEQ ID NO: 4476) |
| HIF-1α-3179 21 nt Targ: | 5'-TTTTTATTTATTTATTTTTGG-3' | (SEQ ID NO: 4477) |
| HIF-1α-3215 21 nt Targ: | 5'-CTTTTTCGAATTATTTTTAAG-3' | (SEQ ID NO: 4478) |
| HIF-1α-3241 21 nt Targ: | 5'-GCCAATATAATTTTTGTAAGA-3' | (SEQ ID NO: 4479) |
| HIF-1α-3274 21 nt Targ: | 5'-TTCATCATGATCATAGGCAGT-3' | (SEQ ID NO: 4480) |
| HIF-1α-3276 21 nt Targ: | 5'-CATCATGATCATAGGCAGTTG-3' | (SEQ ID NO: 4481) |
| HIF-1α-3278 21 nt Targ: | 5'-TCATGATCATAGGCAGTTGAA-3' | (SEQ ID NO: 4482) |
| HIF-1α-3280 21 nt Targ: | 5'-ATGATCATAGGCAGTTGAAAA-3' | (SEQ ID NO: 4483) |
| HIF-1α-3292 21 nt Targ: | 5'-AGTTGAAAAATTTTTACACCT-3' | (SEQ ID NO: 4484) |
| HIF-1α-3310 21 nt Targ: | 5'-CCTTTTTTTTCACATTTTACA-3' | (SEQ ID NO: 4485) |
| HIF-1α-3358 21 nt Targ: | 5'-GTGGTAGCCACAATTGCACAA-3' | (SEQ ID NO: 4486) |
| HIF-1α-3360 21 nt Targ: | 5'-GGTAGCCACAATTGCACAATA-3' | (SEQ ID NO: 4487) |
| HIF-1α-3362 21 nt Targ: | 5'-TAGCCACAATTGCACAATATA-3' | (SEQ ID NO: 4488) |
| HIF-1α-3364 21 nt Targ: | 5'-GCCACAATTGCACAATATATT-3' | (SEQ ID NO: 4489) |
| HIF-1α-3366 21 nt Targ: | 5'-CACAATTGCACAATATATTTT-3' | (SEQ ID NO: 4490) |
| HIF-1α-3368 21 nt Targ: | 5'-CAATTGCACAATATATTTTCT-3' | (SEQ ID NO: 4491) |
| HIF-1α-3374 21 nt Targ: | 5'-CACAATATATTTTCTTAAAAA-3' | (SEQ ID NO: 4492) |
| HIF-1α-3425 21 nt Targ: | 5'-GCGTTTATAAAACTAGTTTTT-3' | (SEQ ID NO: 4493) |
| HIF-1α-3426 21 nt Targ: | 5'-CGTTTATAAAACTAGTTTTTA-3' | (SEQ ID NO: 4494) |
| HIF-1α-3428 21 nt Targ: | 5'-TTTATAAAACTAGTTTTTAAG-3' | (SEQ ID NO: 4495) |
| HIF-1α-3430 21 nt Targ: | 5'-TATAAAACTAGTTTTTAAGAA-3' | (SEQ ID NO: 4496) |
| HIF-1α-3442 21 nt Targ: | 5'-TTTTAAGAAGAAATTTTTTTT-3' | (SEQ ID NO: 4497) |
| HIF-1α-3448 21 nt Targ: | 5'-GAAGAAATTTTTTTGGCCTA-3' | (SEQ ID NO: 4498) |
| HIF-1α-3450 21 nt Targ: | 5'-AGAAATTTTTTTGGCCTATG-3' | (SEQ ID NO: 4499) |
| HIF-1α-3465 21 nt Targ: | 5'-CCTATGAAATTGTTAAACCTG-3' | (SEQ ID NO: 4500) |
| HIF-1α-3493 21 nt Targ: | 5'-ACATTGTTAATCATATAATAA-3' | (SEQ ID NO: 4501) |
| HIF-1α-3529 21 nt Targ: | 5'-GTATGGTTTATTATTTAAATG-3' | (SEQ ID NO: 4502) |
| HIF-1α-3546 21 nt Targ: | 5'-AATGGGTAAAGCCATTTACAT-3' | (SEQ ID NO: 4503) |
| HIF-1α-3557 21 nt Targ: | 5'-CCATTTACATAATATAGAAAG-3' | (SEQ ID NO: 4504) |
| HIF-1α-3592 21 nt Targ: | 5'-AGAAGGTATGTGGCATTTATT-3' | (SEQ ID NO: 4505) |
| HIF-1α-3594 21 nt Targ: | 5'-AAGGTATGTGGCATTTATTTG-3' | (SEQ ID NO: 4506) |
| HIF-1α-3596 21 nt Targ: | 5'-GGTATGTGGCATTTATTTGGA-3' | (SEQ ID NO: 4507) |
| HIF-1α-3598 21 nt Targ: | 5'-TATGTGGCATTTATTTGGATA-3' | (SEQ ID NO: 4508) |

TABLE 5-continued

DsiRNA Target Sequences (21mers) In HIF-1α mRNA

| | | | |
|---|---|---|---|
| HIF-1α-3600 21 nt Targ: | 5'-TGTGGCATTTATTTGGATAAA-3' | (SEQ ID NO: 4509) |
| HIF-1α-3602 21 nt Targ: | 5'-TGGCATTTATTTGGATAAAAT-3' | (SEQ ID NO: 4510) |
| HIF-1α-3604 21 nt Targ: | 5'-GCATTTATTTGGATAAAATTC-3' | (SEQ ID NO: 4511) |
| HIF-1α-3606 21 nt Targ: | 5'-ATTTATTTGGATAAAATTCTC-3' | (SEQ ID NO: 4512) |
| HIF-1α-3608 21 nt Targ: | 5'-TTATTTGGATAAAATTCTCAA-3' | (SEQ ID NO: 4513) |
| HIF-1α-3608 21 nt Targ: | 5'-TTATTTGGATAAAATTCTCAA-3' | (SEQ ID NO: 4514) |
| HIF-1α-3610 21 nt Targ: | 5'-ATTTGGATAAAATTCTCAATT-3' | (SEQ ID NO: 4515) |
| HIF-1α-3612 21 nt Targ: | 5'-TTGGATAAAATTCTCAATTCA-3' | (SEQ ID NO: 4516) |
| HIF-1α-3614 21 nt Targ: | 5'-GGATAAAATTCTCAATTCAGA-3' | (SEQ ID NO: 4517) |
| HIF-1α-3616 21 nt Targ: | 5'-ATAAAATTCTCAATTCAGAGA-3' | (SEQ ID NO: 4518) |
| HIF-1α-3640 21 nt Targ: | 5'-CATCTGATGTTTCTATAGTCA-3' | (SEQ ID NO: 4519) |
| HIF-1α-3646 21 nt Targ: | 5'-ATGTTTCTATAGTCACTTTGC-3' | (SEQ ID NO: 4520) |
| HIF-1α-3651 21 nt Targ: | 5'-TCTATAGTCACTTTGCCAGCT-3' | (SEQ ID NO: 4521) |
| HIF-1α-3670 21 nt Targ: | 5'-CTCAAAAGAAAACAATACCCT-3' | (SEQ ID NO: 4522) |
| HIF-1α-3743 21 nt Targ: | 5'-TGTTCTGCCTACCCTGTTGGT-3' | (SEQ ID NO: 4523) |
| HIF-1α-3745 21 nt Targ: | 5'-TTCTGCCTACCCTGTTGGTAT-3' | (SEQ ID NO: 4524) |
| HIF-1α-3746 21 nt Targ: | 5'-TCTGCCTACCCTGTTGGTATA-3' | (SEQ ID NO: 4525) |
| HIF-1α-3748 21 nt Targ: | 5'-TGCCTACCCTGTTGGTATAAA-3' | (SEQ ID NO: 4526) |
| HIF-1α-3749 21 nt Targ: | 5'-GCCTACCCTGTTGGTATAAAG-3' | (SEQ ID NO: 4527) |
| HIF-1α-3754 21 nt Targ: | 5'-CCCTGTTGGTATAAAGATATT-3' | (SEQ ID NO: 4528) |
| HIF-1α-3757 21 nt Targ: | 5'-TGTTGGTATAAAGATATTTG-3' | (SEQ ID NO: 4529) |
| HIF-1α-3791 21 nt Targ: | 5'-CAAGAAAAAAAAATCATGCA-3' | (SEQ ID NO: 4530) |
| HIF-1α-3830 21 nt Targ: | 5'-AGTATGTTAATTTGCTCAAAA-3' | (SEQ ID NO: 4531) |
| HIF-1α-3861 21 nt Targ: | 5'-GATTTTATGCACTTTGTCGCT-3' | (SEQ ID NO: 4532) |
| HIF-1α-3863 21 nt Targ: | 5'-TTTTATGCACTTTGTCGCTAT-3' | (SEQ ID NO: 4533) |
| HIF-1α-3865 21 nt Targ: | 5'-TTATGCACTTTGTCGCTATTA-3' | (SEQ ID NO: 4534) |
| HIF-1α-3867 21 nt Targ: | 5'-ATGCACTTTGTCGCTATTAAC-3' | (SEQ ID NO: 4535) |
| HIF-1α-3869 21 nt Targ: | 5'-GCACTTTGTCGCTATTAACAT-3' | (SEQ ID NO: 4536) |
| HIF-1α-3871 21 nt Targ: | 5'-ACTTTGTCGCTATTAACATCC-3' | (SEQ ID NO: 4537) |
| HIF-1α-3873 21 nt Targ: | 5'-TTTGTCGCTATTAACATCCTT-3' | (SEQ ID NO: 4538) |
| HIF-1α-3875 21 nt Targ: | 5'-TGTCGCTATTAACATCCTTTT-3' | (SEQ ID NO: 4539) |
| HIF-1α-3877 21 nt Targ: | 5'-TCGCTATTAACATCCTTTTTT-3' | (SEQ ID NO: 4540) |
| HIF-1α-3880 21 nt Targ: | 5'-CTATTAACATCCTTTTTTTCA-3' | (SEQ ID NO: 4541) |
| HIF-1α-3916 21 nt Targ: | 5'-TTGAGTAATTTTAGAAGCATT-3' | (SEQ ID NO: 4542) |
| HIF-1α-3918 21 nt Targ: | 5'-GAGTAATTTTAGAAGCATTAT-3' | (SEQ ID NO: 4543) |
| HIF-1α-3920 21 nt Targ: | 5'-GTAATTTTAGAAGCATTATTT-3' | (SEQ ID NO: 4544) |
| HIF-1α-3922 21 nt Targ: | 5'-AATTTTAGAAGCATTATTTTA-3' | (SEQ ID NO: 4545) |
| HIF-1α-3924 21 nt Targ: | 5'-TTTTAGAAGCATTATTTTAGG-3' | (SEQ ID NO: 4546) |
| HIF-1α-3926 21 nt Targ: | 5'-TTAGAAGCATTATTTTAGGAA-3' | (SEQ ID NO: 4547) |

TABLE 5-continued

| DsiRNA Target Sequences (21mers) In HIF-1α mRNA | | |
|---|---|---|
| HIF-1α-3928 21 nt Targ: | 5'-AGAAGCATTATTTTAGGAATA-3' | (SEQ ID NO: 4548) |
| HIF-1α-3930 21 nt Targ: | 5'-AAGCATTATTTTAGGAATATA-3' | (SEQ ID NO: 4549) |
| HIF-1α-3961 21 nt Targ: | 5'-AGTAAATATCTTGTTTTTCT-3' | (SEQ ID NO: 4550) |
| HIF-1α-3980 21 nt Targ: | 5'-CTATGTACATTGTACAAATTT-3' | (SEQ ID NO: 4551) |
| HIF-1α-3999 21 nt Targ: | 5'-TTTTCATTCCTTTTGCTCTTT-3' | (SEQ ID NO: 4552) |
| HIF-1α-4000 21 nt Targ: | 5'-TTTCATTCCTTTTGCTCTTTG-3' | (SEQ ID NO: 4553) |
| HIF-1α-4001 21 nt Targ: | 5'-TTCATTCCTTTTGCTCTTTGT-3' | (SEQ ID NO: 4554) |
| HIF-1α-4003 21 nt Targ: | 5'-CATTCCTTTTGCTCTTTGTGG-3' | (SEQ ID NO: 4555) |
| HIF-1α-4004 21 nt Targ: | 5'-ATTCCTTTTGCTCTTTGTGGT-3' | (SEQ ID NO: 4556) |
| HIF-1α-4005 21 nt Targ: | 5'-TTCCTTTTGCTCTTTGTGGTT-3' | (SEQ ID NO: 4557) |
| HIF-1α-4006 21 nt Targ: | 5'-TCCTTTTGCTCTTTGTGGTTG-3' | (SEQ ID NO: 4558) |
| HIF-1α-4007 21 nt Targ: | 5'-CCTTTTGCTCTTTGTGGTTGG-3' | (SEQ ID NO: 4559) |
| HIF-1α-4008 21 nt Targ: | 5'-CTTTTGCTCTTTGTGGTTGGA-3' | (SEQ ID NO: 4560) |
| HIF-1α-4009 21 nt Targ: | 5'-TTTTGCTCTTTGTGGTTGGAT-3' | (SEQ ID NO: 4561) |
| HIF-1α-4010 21 nt Targ: | 5'-TTTGCTCTTTGTGGTTGGATC-3' | (SEQ ID NO: 4562) |
| HIF-1α-4012 21 nt Targ: | 5'-TGCTCTTTGTGGTTGGATCTA-3' | (SEQ ID NO: 4563) |
| HIF-1α-4055 21 nt Targ: | 5'-ACATCAAATAAACATCTTCTG-3' | (SEQ ID NO: 4564) |
| HIF-1α-4057 21 nt Targ: | 5'-ATCAAATAAACATCTTCTGTG-3' | (SEQ ID NO: 4565) |
| HIF-1α-4059 21 nt Targ: | 5'-CAAATAAACATCTTCTGTGGA-3' | (SEQ ID NO: 4566) |
| HIF-1α-4061 21 nt Targ: | 5'-AATAAACATCTTCTGTGGACC-3' | (SEQ ID NO: 4567) |
| HIF-1α-4063 21 nt Targ: | 5'-TAAACATCTTCTGTGGACCAG-3' | (SEQ ID NO: 4568) |
| HIF-1α-4065 21 nt Targ: | 5'-AACATCTTCTGTGGACCAGGC-3' | (SEQ ID NO: 4569) |
| HIF-1α-m38 21 nt Targ: | 5'-GCCCGCGGGCGCGCGTTGG-3' | (SEQ ID NO: 4570) |
| HIF-1α-m40 21 nt Targ: | 5'-CCGCGGGCGCGCGTTGGGT-3' | (SEQ ID NO: 4571) |
| HIF-1α-m41 21 nt Targ: | 5'-CGCGGGCGCGCGTTGGGTG-3' | (SEQ ID NO: 4572) |
| HIF-1α-m42 21 nt Targ: | 5'-GCGGGCGCGCGTTGGGTGC-3' | (SEQ ID NO: 4573) |
| HIF-1α-m43 21 nt Targ: | 5'-CGGGCGCGCGTTGGGTGCT-3' | (SEQ ID NO: 4574) |
| HIF-1α-m44 21 nt Targ: | 5'-GGGCGCGCGTTGGGTGCTG-3' | (SEQ ID NO: 4575) |
| HIF-1α-m45 21 nt Targ: | 5'-GGCGCGCGTTGGGTGCTGA-3' | (SEQ ID NO: 4576) |
| HIF-1α-m46 21 nt Targ: | 5'-GCGCGCGTTGGGTGCTGAG-3' | (SEQ ID NO: 4577) |
| HIF-1α-m47 21 nt Targ: | 5'-CGCGCGTTGGGTGCTGAGC-3' | (SEQ ID NO: 4578) |
| HIF-1α-m49 21 nt Targ: | 5'-CGCGCGTTGGGTGCTGAGCGG-3' | (SEQ ID NO: 4579) |
| HIF-1α-m50 21 nt Targ: | 5'-GCGCGTTGGGTGCTGAGCGGG-3' | (SEQ ID NO: 4580) |
| HIF-1α-m51 21 nt Targ: | 5'-CGCGTTGGGTGCTGAGCGGGC-3' | (SEQ ID NO: 4581) |
| HIF-1α-m52 21 nt Targ: | 5'-GCGTTGGGTGCTGAGCGGGCG-3' | (SEQ ID NO: 4582) |
| HIF-1α-m53 21 nt Targ: | 5'-CGTTGGGTGCTGAGCGGGCGC-3' | (SEQ ID NO: 4583) |
| HIF-1α-m55 21 nt Targ: | 5'-TTGGGTGCTGAGCGGGCGCGC-3' | (SEQ ID NO: 4584) |
| HIF-1α-m97 21 nt Targ: | 5'-CCCTCGCCGCGCCCGAGCG-3' | (SEQ ID NO: 4585) |
| HIF-1α-m98 21 nt Targ: | 5'-CCTCGCCGCGCGCCCGAGCGC-3' | (SEQ ID NO: 4586) |

TABLE 5-continued

DsiRNA Target Sequences (21mers) In HIF-1α mRNA

| | | |
|---|---|---|
| HIF-1α-m99 21 nt Targ: | 5'-CTCGCCGCGCGCCCGAGCGCG-3' | (SEQ ID NO: 4587) |
| HIF-1α-m100 21 nt Targ: | 5'-TCGCCGCGCGCCCGAGCGCGC-3' | (SEQ ID NO: 4588) |
| HIF-1α-m139 21 nt Targ: | 5'-CCTGCCGCTGCTTCAGCGCCT-3' | (SEQ ID NO: 4589) |
| HIF-1α-m141 21 nt Targ: | 5'-TGCCGCTGCTTCAGCGCCTCA-3' | (SEQ ID NO: 4590) |
| HIF-1α-m145 21 nt Targ: | 5'-GCTGCTTCAGCGCCTCAGTGC-3' | (SEQ ID NO: 4591) |
| HIF-1α-m146 21 nt Targ: | 5'-CTGCTTCAGCGCCTCAGTGCA-3' | (SEQ ID NO: 4592) |
| HIF-1α-m148 21 nt Targ: | 5'-GCTTCAGCGCCTCAGTGCACA-3' | (SEQ ID NO: 4593) |
| HIF-1α-m152 21 nt Targ: | 5'-CAGCGCCTCAGTGCACAGAGC-3' | (SEQ ID NO: 4594) |
| HIF-1α-m271 21 nt Targ: | 5'-GAGCCGGAGCTCAGCGAGCGC-3' | (SEQ ID NO: 4595) |
| HIF-1α-m277 21 nt Targ: | 5'-GAGCTCAGCGAGCGCAGCCTG-3' | (SEQ ID NO: 4596) |
| HIF-1α-m282 21 nt Targ: | 5'-CAGCGAGCGCAGCCTGCAGCT-3' | (SEQ ID NO: 4597) |
| HIF-1α-m283 21 nt Targ: | 5'-AGCGAGCGCAGCCTGCAGCTC-3' | (SEQ ID NO: 4598) |
| HIF-1α-m284 21 nt Targ: | 5'-GCGAGCGCAGCCTGCAGCTCC-3' | (SEQ ID NO: 4599) |
| HIF-1α-m286 21 nt Targ: | 5'-GAGCGCAGCCTGCAGCTCCCG-3' | (SEQ ID NO: 4600) |
| HIF-1α-m289 21 nt Targ: | 5'-CGCAGCCTGCAGCTCCCGCCT-3' | (SEQ ID NO: 4601) |
| HIF-1α-m348 21 nt Targ: | 5'-TGGACTTGTCTCTTTCTCCGC-3' | (SEQ ID NO: 4602) |
| HIF-1α-m350 21 nt Targ: | 5'-GACTTGTCTCTTTCTCCGCGC-3' | (SEQ ID NO: 4603) |
| HIF-1α-m352 21 nt Targ: | 5'-CTTGTCTCTTTCTCCGCGCGC-3' | (SEQ ID NO: 4604) |
| HIF-1α-m353 21 nt Targ: | 5'-TTGTCTCTTTCTCCGCGCGCG-3' | (SEQ ID NO: 4605) |
| HIF-1α-m354 21 nt Targ: | 5'-TGTCTCTTTCTCCGCGCGCGC-3' | (SEQ ID NO: 4606) |
| HIF-1α-m357 21 nt Targ: | 5'-CTCTTTCTCCGCGCGCGCGGA-3' | (SEQ ID NO: 4607) |
| HIF-1α-m359 21 nt Targ: | 5'-CTTTCTCCGCGCGCGCGGACA-3' | (SEQ ID NO: 4608) |
| HIF-1α-m365 21 nt Targ: | 5'-CCGCGCGCGCGGACAGAGCCG-3' | (SEQ ID NO: 4609) |
| HIF-1α-m597 21 nt Targ: | 5'-GTGAGCTCACATCTTGATAAA-3' | (SEQ ID NO: 4610) |
| HIF-1α-m600 21 nt Targ: | 5'-AGCTCACATCTTGATAAAGCT-3' | (SEQ ID NO: 4611) |
| HIF-1α-m712 21 nt Targ: | 5'-TGGACTGTTTTTATCTGAAAG-3' | (SEQ ID NO: 4612) |
| HIF-1α-m1093 21 nt Targ: | 5'-CACCCATGACGTGCTTGGTGC-3' | (SEQ ID NO: 4613) |
| HIF-1α-m1593 21 nt Targ: | 5'-GATACAAGCTGCCTTTTTGAT-3' | (SEQ ID NO: 4614) |
| HIF-1α-m1595 21 nt Targ: | 5'-TACAAGCTGCCTTTTTGATAA-3' | (SEQ ID NO: 4615) |
| HIF-1α-m1596 21 nt Targ: | 5'-ACAAGCTGCCTTTTTGATAAG-3' | (SEQ ID NO: 4616) |
| HIF-1α-m1599 21 nt Targ: | 5'-AGCTGCCTTTTTGATAAGCTT-3' | (SEQ ID NO: 4617) |
| HIF-1α-m1632 21 nt Targ: | 5'-GATGCTCTCACTCTGCTGGCT-3' | (SEQ ID NO: 4618) |
| HIF-1α-m1633 21 nt Targ: | 5'-ATGCTCTCACTCTGCTGGCTC-3' | (SEQ ID NO: 4619) |
| HIF-1α-m1634 21 nt Targ: | 5'-TGCTCTCACTCTGCTGGCTCC-3' | (SEQ ID NO: 4620) |
| HIF-1α-m1642 21 nt Targ: | 5'-CTCTGCTGGCTCCAGCTGCCG-3' | (SEQ ID NO: 4621) |
| HIF-1α-m1830 21 nt Targ: | 5'-CTTCGAAGTAGTGCTGATCCT-3' | (SEQ ID NO: 4622) |
| HIF-1α-m2041 21 nt Targ: | 5'-AATATTGCTTTGATGTGGATA-3' | (SEQ ID NO: 4623) |
| HIF-1α-m2043 21 nt Targ: | 5'-TATTGCTTTGATGTGGATAGC-3' | (SEQ ID NO: 4624) |
| HIF-1α-m2045 21 nt Targ: | 5'-TTGCTTTGATGTGGATAGCGA-3' | (SEQ ID NO: 4625) |

TABLE 5-continued

DsiRNA Target Sequences (21mers) In HIF-1α mRNA

| | | |
|---|---|---|
| HIF-1α-m2650 21 nt Targ: | 5'-ATGATGGCTCCCTTTTTCAAG-3' | (SEQ ID NO: 4626) |
| HIF-1α-m3030 21 nt Targ: | 5'-GTTTCTGTTGGTTATTTTTGG-3' | (SEQ ID NO: 4627) |
| HIF-1α-m3557 21 nt Targ: | 5'-TGTTAAGCCTGGATCATGAAG-3' | (SEQ ID NO: 4628) |
| HIF-1α-m3562 21 nt Targ: | 5'-AGCCTGGATCATGAAGCTGTT-3' | (SEQ ID NO: 4629) |
| HIF-1α-m3576 21 nt Targ: | 5'-AGCTGTTGATCTTATAATGAT-3' | (SEQ ID NO: 4630) |
| HIF-1α-m3592 21 nt Targ: | 5'-ATGATTCTTAAACTGTATGGT-3' | (SEQ ID NO: 4631) |
| HIF-1α-m3604 21 nt Targ: | 5'-CTGTATGGTTTCTTTATATGG-3' | (SEQ ID NO: 4632) |
| HIF-1α-m4023 21 nt Targ: | 5'-CATAGTAAACATCTTGTTTTT-3' | (SEQ ID NO: 4633) |
| HIF-1α-m4064 21 nt Targ: | 5'-TTTTCGTTCCCTTGCTCTTTG-3' | (SEQ ID NO: 4634) |
| HIF-1α-m4065 21 nt Targ: | 5'-TTTCGTTCCCTTGCTCTTTGT-3' | (SEQ ID NO: 4635) |
| HIF-1α-m4070 21 nt Targ: | 5'-TTCCCTTGCTCTTTGTGGTTG-3' | (SEQ ID NO: 4636) |
| HIF-1α-m4549 21 nt Targ: | 5'-TTTCCGCGCTCTCAGGGAGCT-3' | (SEQ ID NO: 4637) |
| HIF-1α-m4691 21 nt Targ: | 5'-ACCTGATGTTTCTTTACTTTG-3' | (SEQ ID NO: 4638) |
| HIF-1α-m4692 21 nt Targ: | 5'-CCTGATGTTTCTTTACTTTGC-3' | (SEQ ID NO: 4639) |
| HIF-1α-m4693 21 nt Targ: | 5'-CTGATGTTTCTTTACTTTGCC-3' | (SEQ ID NO: 4640) |
| HIF-1α-m4709 21 nt Targ: | 5'-TTGCCAGCTTTAAAAAAGTAT-3' | (SEQ ID NO: 4641) |
| HIF-1α-463 21 nt Targ: | 5'-AAAGATAAGTTCTGAACGTCG-3' | (SEQ ID NO: 4642) |
| HIF-1α-466 21 nt Targ: | 5'-GATAAGTTCTGAACGTCGAAA-3' | (SEQ ID NO: 4643) |
| HIF-1α-468 21 nt Targ: | 5'-TAAGTTCTGAACGTCGAAAAG-3' | (SEQ ID NO: 4644) |
| HIF-1α-472 21 nt Targ: | 5'-TTCTGAACGTCGAAAAGAAAA-3' | (SEQ ID NO: 4645) |
| HIF-1α-480 21 nt Targ: | 5'-GTCGAAAAGAAAAGTCTCGAG-3' | (SEQ ID NO: 4646) |
| HIF-1α-481 21 nt Targ: | 5'-TCGAAAAGAAAAGTCTCGAGA-3' | (SEQ ID NO: 4647) |
| HIF-1α-516 21 nt Targ: | 5'-GGCGAAGTAAAGAATCTGAAG-3' | (SEQ ID NO: 4648) |
| HIF-1α-517 21 nt Targ: | 5'-GCGAAGTAAAGAATCTGAAGT-3' | (SEQ ID NO: 4649) |
| HIF-1α-519 21 nt Targ: | 5'-GAAGTAAAGAATCTGAAGTTT-3' | (SEQ ID NO: 4650) |
| HIF-1α-520 21 nt Targ: | 5'-AAGTAAAGAATCTGAAGTTTT-3' | (SEQ ID NO: 4651) |
| HIF-1α-522 21 nt Targ: | 5'-GTAAAGAATCTGAAGTTTTTT-3' | (SEQ ID NO: 4652) |
| HIF-1α-529 21 nt Targ: | 5'-ATCTGAAGTTTTTTATGAGCT-3' | (SEQ ID NO: 4653) |
| HIF-1α-557 21 nt Targ: | 5'-CAGTTGCCACTTCCACATAAT-3' | (SEQ ID NO: 4654) |
| HIF-1α-576 21 nt Targ: | 5'-ATGTGAGTTCGCATCTTGATA-3' | (SEQ ID NO: 4655) |
| HIF-1α-608 21 nt Targ: | 5'-ATGAGGCTTACCATCAGCTAT-3' | (SEQ ID NO: 4656) |
| HIF-1α-636 21 nt Targ: | 5'-TGAGGAAACTTCTGGATGCTG-3' | (SEQ ID NO: 4657) |
| HIF-1α-652 21 nt Targ: | 5'-TGCTGGTGATTTGGATATTGA-3' | (SEQ ID NO: 4658) |
| HIF-1α-654 21 nt Targ: | 5'-CTGGTGATTTGGATATTGAAG-3' | (SEQ ID NO: 4659) |
| HIF-1α-660 21 nt Targ: | 5'-ATTTGGATATTGAAGATGACA-3' | (SEQ ID NO: 4660) |
| HIF-1α-661 21 nt Targ: | 5'-TTTGGATATTGAAGATGACAT-3' | (SEQ ID NO: 4661) |
| HIF-1α-663 21 nt Targ: | 5'-TGGATATTGAAGATGACATGA-3' | (SEQ ID NO: 4662) |
| HIF-1α-664 21 nt Targ: | 5'-GGATATTGAAGATGACATGAA-3' | (SEQ ID NO: 4663) |
| HIF-1α-671 21 nt Targ: | 5'-GAAGATGACATGAAAGCACAG-3' | (SEQ ID NO: 4664) |

TABLE 5-continued

DsiRNA Target Sequences (21mers) In HIF-1α mRNA

| | | |
|---|---|---|
| HIF-1α-672 21 nt Targ: | 5'-AAGATGACATGAAAGCACAGA-3' | (SEQ ID NO: 4665) |
| HIF-1α-681 21 nt Targ: | 5'-TGAAAGCACAGATGAATTGCT-3' | (SEQ ID NO: 4666) |
| HIF-1α-687 21 nt Targ: | 5'-CACAGATGAATTGCTTTTATT-3' | (SEQ ID NO: 4667) |
| HIF-1α-688 21 nt Targ: | 5'-ACAGATGAATTGCTTTTATTT-3' | (SEQ ID NO: 4668) |
| HIF-1α-701 21 nt Targ: | 5'-TTTTATTTGAAAGCCTTGGAT-3' | (SEQ ID NO: 4669) |
| HIF-1α-702 21 nt Targ: | 5'-TTTATTTGAAAGCCTTGGATG-3' | (SEQ ID NO: 4670) |
| HIF-1α-708 21 nt Targ: | 5'-TGAAAGCCTTGGATGGTTTTG-3' | (SEQ ID NO: 4671) |
| HIF-1α-723 21 nt Targ: | 5'-GTTTTGTTATGGTTCTCACAG-3' | (SEQ ID NO: 4672) |
| HIF-1α-729 21 nt Targ: | 5'-TTATGGTTCTCACAGATGATG-3' | (SEQ ID NO: 4673) |
| HIF-1α-730 21 nt Targ: | 5'-TATGGTTCTCACAGATGATGG-3' | (SEQ ID NO: 4674) |
| HIF-1α-739 21 nt Targ: | 5'-CACAGATGATGGTGACATGAT-3' | (SEQ ID NO: 4675) |
| HIF-1α-744 21 nt Targ: | 5'-ATGATGGTGACATGATTTACA-3' | (SEQ ID NO: 4676) |
| HIF-1α-745 21 nt Targ: | 5'-TGATGGTGACATGATTTACAT-3' | (SEQ ID NO: 4677) |
| HIF-1α-753 21 nt Targ: | 5'-ACATGATTTACATTTCTGATA-3' | (SEQ ID NO: 4678) |
| HIF-1α-755 21 nt Targ: | 5'-ATGATTTACATTTCTGATAAT-3' | (SEQ ID NO: 4679) |
| HIF-1α-757 21 nt Targ: | 5'-GATTTACATTTCTGATAATGT-3' | (SEQ ID NO: 4680) |
| HIF-1α-762 21 nt Targ: | 5'-ACATTTCTGATAATGTGAACA-3' | (SEQ ID NO: 4681) |
| HIF-1α-770 21 nt Targ: | 5'-GATAATGTGAACAAATACATG-3' | (SEQ ID NO: 4682) |
| HIF-1α-771 21 nt Targ: | 5'-ATAATGTGAACAAATACATGG-3' | (SEQ ID NO: 4683) |
| HIF-1α-772 21 nt Targ: | 5'-TAATGTGAACAAATACATGGG-3' | (SEQ ID NO: 4684) |
| HIF-1α-773 21 nt Targ: | 5'-AATGTGAACAAATACATGGGA-3' | (SEQ ID NO: 4685) |
| HIF-1α-774 21 nt Targ: | 5'-ATGTGAACAAATACATGGGAT-3' | (SEQ ID NO: 4686) |
| HIF-1α-775 21 nt Targ: | 5'-TGTGAACAAATACATGGGATT-3' | (SEQ ID NO: 4687) |
| HIF-1α-785 21 nt Targ: | 5'-TACATGGGATTAACTCAGTTT-3' | (SEQ ID NO: 4688) |
| HIF-1α-786 21 nt Targ: | 5'-ACATGGGATTAACTCAGTTTG-3' | (SEQ ID NO: 4689) |
| HIF-1α-801 21 nt Targ: | 5'-AGTTTGAACTAACTGGACACA-3' | (SEQ ID NO: 4690) |
| HIF-1α-811 21 nt Targ: | 5'-AACTGGACACAGTGTGTTTGA-3' | (SEQ ID NO: 4691) |
| HIF-1α-812 21 nt Targ: | 5'-ACTGGACACAGTGTGTTTGAT-3' | (SEQ ID NO: 4692) |
| HIF-1α-825 21 nt Targ: | 5'-TGTTTGATTTTACTCATCCAT-3' | (SEQ ID NO: 4693) |
| HIF-1α-827 21 nt Targ: | 5'-TTTGATTTTACTCATCCATGT-3' | (SEQ ID NO: 4694) |
| HIF-1α-841 21 nt Targ: | 5'-TCCATGTGACCATGAGGAAAT-3' | (SEQ ID NO: 4695) |
| HIF-1α-843 21 nt Targ: | 5'-CATGTGACCATGAGGAAATGA-3' | (SEQ ID NO: 4696) |
| HIF-1α-849 21 nt Targ: | 5'-ACCATGAGGAAATGAGAGAAA-3' | (SEQ ID NO: 4697) |
| HIF-1α-861 21 nt Targ: | 5'-TGAGAGAAATGCTTACACACA-3' | (SEQ ID NO: 4698) |
| HIF-1α-865 21 nt Targ: | 5'-AGAAATGCTTACACACAGAAA-3' | (SEQ ID NO: 4699) |
| HIF-1α-866 21 nt Targ: | 5'-GAAATGCTTACACACAGAAAT-3' | (SEQ ID NO: 4700) |
| HIF-1α-880 21 nt Targ: | 5'-CAGAAATGGCCTTGTGAAAAA-3' | (SEQ ID NO: 4701) |
| HIF-1α-881 21 nt Targ: | 5'-AGAAATGGCCTTGTGAAAAAG-3' | (SEQ ID NO: 4702) |
| HIF-1α-882 21 nt Targ: | 5'-GAAATGGCCTTGTGAAAAAGG-3' | (SEQ ID NO: 4703) |

TABLE 5-continued

DsiRNA Target Sequences (21mers) In HIF-1α mRNA

| | | |
|---|---|---|
| HIF-1α-883 21 nt Targ: | 5'-AAATGGCCTTGTGAAAAAGGG-3' | (SEQ ID NO: 4704) |
| HIF-1α-888 21 nt Targ: | 5'-GCCTTGTGAAAAAGGGTAAAG-3' | (SEQ ID NO: 4705) |
| HIF-1α-904 21 nt Targ: | 5'-TAAAGAACAAAACACACAGCG-3' | (SEQ ID NO: 4706) |
| HIF-1α-926 21 nt Targ: | 5'-AGCTTTTTTCTCAGAATGAAG-3' | (SEQ ID NO: 4707) |
| HIF-1α-928 21 nt Targ: | 5'-CTTTTTTCTCAGAATGAAGTG-3' | (SEQ ID NO: 4708) |
| HIF-1α-938 21 nt Targ: | 5'-AGAATGAAGTGTACCCTAACT-3' | (SEQ ID NO: 4709) |
| HIF-1α-962 21 nt Targ: | 5'-CGAGGAAGAACTATGAACATA-3' | (SEQ ID NO: 4710) |
| HIF-1α-963 21 nt Targ: | 5'-GAGGAAGAACTATGAACATAA-3' | (SEQ ID NO: 4711) |
| HIF-1α-964 21 nt Targ: | 5'-AGGAAGAACTATGAACATAAA-3' | (SEQ ID NO: 4712) |
| HIF-1α-1012 21 nt Targ: | 5'-CACAGGCCACATTCACGTATA-3' | (SEQ ID NO: 4713) |
| HIF-1α-1058 21 nt Targ: | 5'-TGTGGGTATAAGAAACCACCT-3' | (SEQ ID NO: 4714) |
| HIF-1α-1059 21 nt Targ: | 5'-GTGGGTATAAGAAACCACCTA-3' | (SEQ ID NO: 4715) |
| HIF-1α-1123 21 nt Targ: | 5'-AAATATTGAAATTCCTTTAGA-3' | (SEQ ID NO: 4716) |
| HIF-1α-1129 21 nt Targ: | 5'-TGAAATTCCTTTAGATAGCAA-3' | (SEQ ID NO: 4717) |
| HIF-1α-1173 21 nt Targ: | 5'-TGGATATGAAATTTTCTTATT-3' | (SEQ ID NO: 4718) |
| HIF-1α-1176 21 nt Targ: | 5'-ATATGAAATTTTCTTATTGTG-3' | (SEQ ID NO: 4719) |
| HIF-1α-1177 21 nt Targ: | 5'-TATGAAATTTTCTTATTGTGA-3' | (SEQ ID NO: 4720) |
| HIF-1α-1178 21 nt Targ: | 5'-ATGAAATTTTCTTATTGTGAT-3' | (SEQ ID NO: 4721) |
| HIF-1α-1180 21 nt Targ: | 5'-GAAATTTTCTTATTGTGATGA-3' | (SEQ ID NO: 4722) |
| HIF-1α-1181 21 nt Targ: | 5'-AAATTTTCTTATTGTGATGAA-3' | (SEQ ID NO: 4723) |
| HIF-1α-1182 21 nt Targ: | 5'-AATTTTCTTATTGTGATGAAA-3' | (SEQ ID NO: 4724) |
| HIF-1α-1186 21 nt Targ: | 5'-TTCTTATTGTGATGAAAGAAT-3' | (SEQ ID NO: 4725) |
| HIF-1α-1191 21 nt Targ: | 5'-ATTGTGATGAAAGAATTACCG-3' | (SEQ ID NO: 4726) |
| HIF-1α-1193 21 nt Targ: | 5'-TGTGATGAAAGAATTACCGAA-3' | (SEQ ID NO: 4727) |
| HIF-1α-1198 21 nt Targ: | 5'-TGAAAGAATTACCGAATTGAT-3' | (SEQ ID NO: 4728) |
| HIF-1α-1199 21 nt Targ: | 5'-GAAAGAATTACCGAATTGATG-3' | (SEQ ID NO: 4729) |
| HIF-1α-1200 21 nt Targ: | 5'-AAAGAATTACCGAATTGATGG-3' | (SEQ ID NO: 4730) |
| HIF-1α-1201 21 nt Targ: | 5'-AAGAATTACCGAATTGATGGG-3' | (SEQ ID NO: 4731) |
| HIF-1α-1215 21 nt Targ: | 5'-TGATGGGATATGAGCCAGAAG-3' | (SEQ ID NO: 4732) |
| HIF-1α-1222 21 nt Targ: | 5'-ATATGAGCCAGAAGAACTTTT-3' | (SEQ ID NO: 4733) |
| HIF-1α-1240 21 nt Targ: | 5'-TTTAGGCCGCTCAATTTATGA-3' | (SEQ ID NO: 4734) |
| HIF-1α-1254 21 nt Targ: | 5'-TTTATGAATATTATCATGCTT-3' | (SEQ ID NO: 4735) |
| HIF-1α-1256 21 nt Targ: | 5'-TATGAATATTATCATGCTTTG-3' | (SEQ ID NO: 4736) |
| HIF-1α-1287 21 nt Targ: | 5'-ATCTGACCAAAACTCATCATG-3' | (SEQ ID NO: 4737) |
| HIF-1α-1292 21 nt Targ: | 5'-ACCAAAACTCATCATGATATG-3' | (SEQ ID NO: 4738) |
| HIF-1α-1293 21 nt Targ: | 5'-CCAAAACTCATCATGATATGT-3' | (SEQ ID NO: 4739) |
| HIF-1α-1302 21 nt Targ: | 5'-ATCATGATATGTTTACTAAAG-3' | (SEQ ID NO: 4740) |
| HIF-1α-1306 21 nt Targ: | 5'-TGATATGTTTACTAAAGGACA-3' | (SEQ ID NO: 4741) |
| HIF-1α-1362 21 nt Targ: | 5'-GAGGTGGATATGTCTGGGTTG-3' | (SEQ ID NO: 4742) |

TABLE 5-continued

DsiRNA Target Sequences (21mers) In HIF-1α mRNA

| | | |
|---|---|---|
| HIF-1α-1376 21 nt Targ: | 5'-TGGGTTGAAACTCAAGCAACT-3' | (SEQ ID NO: 4743) |
| HIF-1α-1393 21 nt Targ: | 5'-AACTGTCATATATAACACCAA-3' | (SEQ ID NO: 4744) |
| HIF-1α-1409 21 nt Targ: | 5'-ACCAAGAATTCTCAACCACAG-3' | (SEQ ID NO: 4745) |
| HIF-1α-1425 21 nt Targ: | 5'-CACAGTGCATTGTATGTGTGA-3' | (SEQ ID NO: 4746) |
| HIF-1α-1426 21 nt Targ: | 5'-ACAGTGCATTGTATGTGTGAA-3' | (SEQ ID NO: 4747) |
| HIF-1α-1438 21 nt Targ: | 5'-ATGTGTGAATTACGTTGTGAG-3' | (SEQ ID NO: 4748) |
| HIF-1α-1439 21 nt Targ: | 5'-TGTGTGAATTACGTTGTGAGT-3' | (SEQ ID NO: 4749) |
| HIF-1α-1440 21 nt Targ: | 5'-GTGTGAATTACGTTGTGAGTG-3' | (SEQ ID NO: 4750) |
| HIF-1α-1441 21 nt Targ: | 5'-TGTGAATTACGTTGTGAGTGG-3' | (SEQ ID NO: 4751) |
| HIF-1α-1459 21 nt Targ: | 5'-TGGTATTATTCAGCACGACTT-3' | (SEQ ID NO: 4752) |
| HIF-1α-1477 21 nt Targ: | 5'-CTTGATTTTCTCCCTTCAACA-3' | (SEQ ID NO: 4753) |
| HIF-1α-1494 21 nt Targ: | 5'-AACAAACAGAATGTGTCCTTA-3' | (SEQ ID NO: 4754) |
| HIF-1α-1503 21 nt Targ: | 5'-AATGTGTCCTTAAACCGGTTG-3' | (SEQ ID NO: 4755) |
| HIF-1α-1516 21 nt Targ: | 5'-ACCGGTTGAATCTTCAGATAT-3' | (SEQ ID NO: 4756) |
| HIF-1α-1517 21 nt Targ: | 5'-CCGGTTGAATCTTCAGATATG-3' | (SEQ ID NO: 4757) |
| HIF-1α-1518 21 nt Targ: | 5'-CGGTTGAATCTTCAGATATGA-3' | (SEQ ID NO: 4758) |
| HIF-1α-1520 21 nt Targ: | 5'-GTTGAATCTTCAGATATGAAA-3' | (SEQ ID NO: 4759) |
| HIF-1α-1521 21 nt Targ: | 5'-TTGAATCTTCAGATATGAAAA-3' | (SEQ ID NO: 4760) |
| HIF-1α-1531 21 nt Targ: | 5'-AGATATGAAAATGACTCAGCT-3' | (SEQ ID NO: 4761) |
| HIF-1α-1532 21 nt Targ: | 5'-GATATGAAAATGACTCAGCTA-3' | (SEQ ID NO: 4762) |
| HIF-1α-1559 21 nt Targ: | 5'-AAAGTTGAATCAGAAGATACA-3' | (SEQ ID NO: 4763) |
| HIF-1α-1561 21 nt Targ: | 5'-AGTTGAATCAGAAGATACAAG-3' | (SEQ ID NO: 4764) |
| HIF-1α-1569 21 nt Targ: | 5'-CAGAAGATACAAGTAGCCTCT-3' | (SEQ ID NO: 4765) |
| HIF-1α-1570 21 nt Targ: | 5'-AGAAGATACAAGTAGCCTCTT-3' | (SEQ ID NO: 4766) |
| HIF-1α-1571 21 nt Targ: | 5'-GAAGATACAAGTAGCCTCTTT-3' | (SEQ ID NO: 4767) |
| HIF-1α-1586 21 nt Targ: | 5'-CTCTTTGACAAACTTAAGAAG-3' | (SEQ ID NO: 4768) |
| HIF-1α-1587 21 nt Targ: | 5'-TCTTTGACAAACTTAAGAAGG-3' | (SEQ ID NO: 4769) |
| HIF-1α-1609 21 nt Targ: | 5'-ACCTGATGCTTTAACTTTGCT-3' | (SEQ ID NO: 4770) |
| HIF-1α-1641 21 nt Targ: | 5'-CTGGAGACACAATCATATCTT-3' | (SEQ ID NO: 4771) |
| HIF-1α-1642 21 nt Targ: | 5'-TGGAGACACAATCATATCTTT-3' | (SEQ ID NO: 4772) |
| HIF-1α-1701 21 nt Targ: | 5'-AACTTGAGGAAGTACCATTAT-3' | (SEQ ID NO: 4773) |
| HIF-1α-1702 21 nt Targ: | 5'-ACTTGAGGAAGTACCATTATA-3' | (SEQ ID NO: 4774) |
| HIF-1α-1704 21 nt Targ: | 5'-TTGAGGAAGTACCATTATATA-3' | (SEQ ID NO: 4775) |
| HIF-1α-1705 21 nt Targ: | 5'-TGAGGAAGTACCATTATATAA-3' | (SEQ ID NO: 4776) |
| HIF-1α-1707 21 nt Targ: | 5'-AGGAAGTACCATTATATAATG-3' | (SEQ ID NO: 4777) |
| HIF-1α-1708 21 nt Targ: | 5'-GGAAGTACCATTATATAATGA-3' | (SEQ ID NO: 4778) |
| HIF-1α-1748 21 nt Targ: | 5'-AACGAAAAATTACAGAATATA-3' | (SEQ ID NO: 4779) |
| HIF-1α-1749 21 nt Targ: | 5'-ACGAAAAATTACAGAATATAA-3' | (SEQ ID NO: 4780) |
| HIF-1α-1752 21 nt Targ: | 5'-AAAAATTACAGAATATAAATT-3' | (SEQ ID NO: 4781) |

TABLE 5-continued

| DsiRNA Target Sequences (21mers) In HIF-1α mRNA | | |
|---|---|---|
| HIF-1α-1758 21 nt Targ: | 5'-TACAGAATATAAATTTGGCAA-3' | (SEQ ID NO: 4782) |
| HIF-1α-1759 21 nt Targ: | 5'-ACAGAATATAAATTTGGCAAT-3' | (SEQ ID NO: 4783) |
| HIF-1α-1842 21 nt Targ: | 5'-ATCAAGAAGTTGCATTAAAAT-3' | (SEQ ID NO: 4784) |
| HIF-1α-1843 21 nt Targ: | 5'-TCAAGAAGTTGCATTAAAATT-3' | (SEQ ID NO: 4785) |
| HIF-1α-1857 21 nt Targ: | 5'-TAAAATTAGAACCAAATCCAG-3' | (SEQ ID NO: 4786) |
| HIF-1α-1858 21 nt Targ: | 5'-AAAATTAGAACCAAATCCAGA-3' | (SEQ ID NO: 4787) |
| HIF-1α-1874 21 nt Targ: | 5'-CCAGAGTCACTGGAACTTTCT-3' | (SEQ ID NO: 4788) |
| HIF-1α-1875 21 nt Targ: | 5'-CAGAGTCACTGGAACTTTCTT-3' | (SEQ ID NO: 4789) |
| HIF-1α-1881 21 nt Targ: | 5'-CACTGGAACTTTCTTTTACCA-3' | (SEQ ID NO: 4790) |
| HIF-1α-1966 21 nt Targ: | 5'-GCCTAATAGTCCCAGTGAATA-3' | (SEQ ID NO: 4791) |
| HIF-1α-1967 21 nt Targ: | 5'-CCTAATAGTCCCAGTGAATAT-3' | (SEQ ID NO: 4792) |
| HIF-1α-1968 21 nt Targ: | 5'-CTAATAGTCCCAGTGAATATT-3' | (SEQ ID NO: 4793) |
| HIF-1α-1969 21 nt Targ: | 5'-TAATAGTCCCAGTGAATATTG-3' | (SEQ ID NO: 4794) |
| HIF-1α-1970 21 nt Targ: | 5'-AATAGTCCCAGTGAATATTGT-3' | (SEQ ID NO: 4795) |
| HIF-1α-1978 21 nt Targ: | 5'-CAGTGAATATTGTTTTATGT-3' | (SEQ ID NO: 4796) |
| HIF-1α-1979 21 nt Targ: | 5'-AGTGAATATTGTTTTATGTG-3' | (SEQ ID NO: 4797) |
| HIF-1α-1981 21 nt Targ: | 5'-TGAATATTGTTTTATGTGGA-3' | (SEQ ID NO: 4798) |
| HIF-1α-1983 21 nt Targ: | 5'-AATATTGTTTTATGTGGATA-3' | (SEQ ID NO: 4799) |
| HIF-1α-1984 21 nt Targ: | 5'-ATATTGTTTTATGTGGATAG-3' | (SEQ ID NO: 4800) |
| HIF-1α-1986 21 nt Targ: | 5'-ATTGTTTTATGTGGATAGTG-3' | (SEQ ID NO: 4801) |
| HIF-1α-1989 21 nt Targ: | 5'-GTTTTATGTGGATAGTGATA-3' | (SEQ ID NO: 4802) |
| HIF-1α-1996 21 nt Targ: | 5'-TGTGGATAGTGATATGGTCAA-3' | (SEQ ID NO: 4803) |
| HIF-1α-1998 21 nt Targ: | 5'-TGGATAGTGATATGGTCAATG-3' | (SEQ ID NO: 4804) |
| HIF-1α-1999 21 nt Targ: | 5'-GGATAGTGATATGGTCAATGA-3' | (SEQ ID NO: 4805) |
| HIF-1α-2000 21 nt Targ: | 5'-GATAGTGATATGGTCAATGAA-3' | (SEQ ID NO: 4806) |
| HIF-1α-2004 21 nt Targ: | 5'-GTGATATGGTCAATGAATTCA-3' | (SEQ ID NO: 4807) |
| HIF-1α-2007 21 nt Targ: | 5'-ATATGGTCAATGAATTCAAGT-3' | (SEQ ID NO: 4808) |
| HIF-1α-2008 21 nt Targ: | 5'-TATGGTCAATGAATTCAAGTT-3' | (SEQ ID NO: 4809) |
| HIF-1α-2013 21 nt Targ: | 5'-TCAATGAATTCAAGTTGGAAT-3' | (SEQ ID NO: 4810) |
| HIF-1α-2014 21 nt Targ: | 5'-CAATGAATTCAAGTTGGAATT-3' | (SEQ ID NO: 4811) |
| HIF-1α-2016 21 nt Targ: | 5'-ATGAATTCAAGTTGGAATTGG-3' | (SEQ ID NO: 4812) |
| HIF-1α-2022 21 nt Targ: | 5'-TCAAGTTGGAATTGGTAGAAA-3' | (SEQ ID NO: 4813) |
| HIF-1α-2028 21 nt Targ: | 5'-TGGAATTGGTAGAAAACTTT-3' | (SEQ ID NO: 4814) |
| HIF-1α-2029 21 nt Targ: | 5'-GGAATTGGTAGAAAACTTTT-3' | (SEQ ID NO: 4815) |
| HIF-1α-2035 21 nt Targ: | 5'-GGTAGAAAACTTTTTGCTGA-3' | (SEQ ID NO: 4816) |
| HIF-1α-2036 21 nt Targ: | 5'-GTAGAAAACTTTTTGCTGAA-3' | (SEQ ID NO: 4817) |
| HIF-1α-2043 21 nt Targ: | 5'-AACTTTTTGCTGAAGACACAG-3' | (SEQ ID NO: 4818) |
| HIF-1α-2050 21 nt Targ: | 5'-TGCTGAAGACACAGAAGCAAA-3' | (SEQ ID NO: 4819) |
| HIF-1α-2051 21 nt Targ: | 5'-GCTGAAGACACAGAAGCAAAG-3' | (SEQ ID NO: 4820) |

TABLE 5-continued

DsiRNA Target Sequences (21mers) In HIF-1α mRNA

| | | |
|---|---|---|
| HIF-1α-2059 21 nt Targ: | 5'-CACAGAAGCAAAGAACCCATT-3' | (SEQ ID NO: 4821) |
| HIF-1α-2068 21 nt Targ: | 5'-AAAGAACCCATTTTCTACTCA-3' | (SEQ ID NO: 4822) |
| HIF-1α-2085 21 nt Targ: | 5'-CTCAGGACACAGATTTAGACT-3' | (SEQ ID NO: 4823) |
| HIF-1α-2092 21 nt Targ: | 5'-CACAGATTTAGACTTGGAGAT-3' | (SEQ ID NO: 4824) |
| HIF-1α-2094 21 nt Targ: | 5'-CAGATTTAGACTTGGAGATGT-3' | (SEQ ID NO: 4825) |
| HIF-1α-2095 21 nt Targ: | 5'-AGATTTAGACTTGGAGATGTT-3' | (SEQ ID NO: 4826) |
| HIF-1α-2105 21 nt Targ: | 5'-TTGGAGATGTTAGCTCCCTAT-3' | (SEQ ID NO: 4827) |
| HIF-1α-2134 21 nt Targ: | 5'-GGATGATGACTTCCAGTTACG-3' | (SEQ ID NO: 4828) |
| HIF-1α-2159 21 nt Targ: | 5'-TTCGATCAGTTGTCACCATTA-3' | (SEQ ID NO: 4829) |
| HIF-1α-2166 21 nt Targ: | 5'-AGTTGTCACCATTAGAAAGCA-3' | (SEQ ID NO: 4830) |
| HIF-1α-2221 21 nt Targ: | 5'-CACAGTTACAGTATTCCAGCA-3' | (SEQ ID NO: 4831) |
| HIF-1α-2295 21 nt Targ: | 5'-ATGAATTAAAAACAGTGACAA-3' | (SEQ ID NO: 4832) |
| HIF-1α-2296 21 nt Targ: | 5'-TGAATTAAAAACAGTGACAAA-3' | (SEQ ID NO: 4833) |
| HIF-1α-2297 21 nt Targ: | 5'-GAATTAAAAACAGTGACAAAA-3' | (SEQ ID NO: 4834) |
| HIF-1α-2305 21 nt Targ: | 5'-AACAGTGACAAAAGACCGTAT-3' | (SEQ ID NO: 4835) |
| HIF-1α-2307 21 nt Targ: | 5'-CAGTGACAAAAGACCGTATGG-3' | (SEQ ID NO: 4836) |
| HIF-1α-2319 21 nt Targ: | 5'-ACCGTATGGAAGACATTAAAA-3' | (SEQ ID NO: 4837) |
| HIF-1α-2322 21 nt Targ: | 5'-GTATGGAAGACATTAAAATAT-3' | (SEQ ID NO: 4838) |
| HIF-1α-2323 21 nt Targ: | 5'-TATGGAAGACATTAAAATATT-3' | (SEQ ID NO: 4839) |
| HIF-1α-2325 21 nt Targ: | 5'-TGGAAGACATTAAAATATTGA-3' | (SEQ ID NO: 4840) |
| HIF-1α-2404 21 nt Targ: | 5'-ATATAGAGATACTCAAAGTCG-3' | (SEQ ID NO: 4841) |
| HIF-1α-2446 21 nt Targ: | 5'-AGGAAAAGGAGTCATAGAACA-3' | (SEQ ID NO: 4842) |
| HIF-1α-2450 21 nt Targ: | 5'-AAAGGAGTCATAGAACAGACA-3' | (SEQ ID NO: 4843) |
| HIF-1α-2451 21 nt Targ: | 5'-AAGGAGTCATAGAACAGACAG-3' | (SEQ ID NO: 4844) |
| HIF-1α-2467 21 nt Targ: | 5'-GACAGAAAAATCTCATCCAAG-3' | (SEQ ID NO: 4845) |
| HIF-1α-2468 21 nt Targ: | 5'-ACAGAAAAATCTCATCCAAGA-3' | (SEQ ID NO: 4846) |
| HIF-1α-2495 21 nt Targ: | 5'-AACGTGTTATCTGTCGCTTTG-3' | (SEQ ID NO: 4847) |
| HIF-1α-2496 21 nt Targ: | 5'-ACGTGTTATCTGTCGCTTTGA-3' | (SEQ ID NO: 4848) |
| HIF-1α-2503 21 nt Targ: | 5'-ATCTGTCGCTTTGAGTCAAAG-3' | (SEQ ID NO: 4849) |
| HIF-1α-2510 21 nt Targ: | 5'-GCTTTGAGTCAAAGAACTACA-3' | (SEQ ID NO: 4850) |
| HIF-1α-2511 21 nt Targ: | 5'-CTTTGAGTCAAAGAACTACAG-3' | (SEQ ID NO: 4851) |
| HIF-1α-2517 21 nt Targ: | 5'-GTCAAAGAACTACAGTTCCTG-3' | (SEQ ID NO: 4852) |
| HIF-1α-2518 21 nt Targ: | 5'-TCAAAGAACTACAGTTCCTGA-3' | (SEQ ID NO: 4853) |
| HIF-1α-2535 21 nt Targ: | 5'-CTGAGGAAGAACTAAATCCAA-3' | (SEQ ID NO: 4854) |
| HIF-1α-2536 21 nt Targ: | 5'-TGAGGAAGAACTAAATCCAAA-3' | (SEQ ID NO: 4855) |
| HIF-1α-2537 21 nt Targ: | 5'-GAGGAAGAACTAAATCCAAAG-3' | (SEQ ID NO: 4856) |
| HIF-1α-2538 21 nt Targ: | 5'-AGGAAGAACTAAATCCAAAGA-3' | (SEQ ID NO: 4857) |
| HIF-1α-2546 21 nt Targ: | 5'-CTAAATCCAAAGATACTAGCT-3' | (SEQ ID NO: 4858) |
| HIF-1α-2551 21 nt Targ: | 5'-TCCAAAGATACTAGCTTTGCA-3' | (SEQ ID NO: 4859) |

TABLE 5-continued

DsiRNA Target Sequences (21mers) In HIF-1α mRNA

| | | | |
|---|---|---|---|
| HIF-1α-2553 21 nt Targ: | 5'-CAAAGATACTAGCTTTGCAGA-3' | (SEQ ID NO: 4860) |
| HIF-1α-2554 21 nt Targ: | 5'-AAAGATACTAGCTTTGCAGAA-3' | (SEQ ID NO: 4861) |
| HIF-1α-2581 21 nt Targ: | 5'-GAGAAAGCGAAAAATGGAACA-3' | (SEQ ID NO: 4862) |
| HIF-1α-2593 21 nt Targ: | 5'-AATGGAACATGATGGTTCACT-3' | (SEQ ID NO: 4863) |
| HIF-1α-2599 21 nt Targ: | 5'-ACATGATGGTTCACTTTTTCA-3' | (SEQ ID NO: 4864) |
| HIF-1α-2611 21 nt Targ: | 5'-ACTTTTTCAAGCAGTAGGAAT-3' | (SEQ ID NO: 4865) |
| HIF-1α-2620 21 nt Targ: | 5'-AGCAGTAGGAATTGGAACATT-3' | (SEQ ID NO: 4866) |
| HIF-1α-2621 21 nt Targ: | 5'-GCAGTAGGAATTGGAACATTA-3' | (SEQ ID NO: 4867) |
| HIF-1α-2622 21 nt Targ: | 5'-CAGTAGGAATTGGAACATTAT-3' | (SEQ ID NO: 4868) |
| HIF-1α-2680 21 nt Targ: | 5'-TTCTTGGAAACGTGTAAAAGG-3' | (SEQ ID NO: 4869) |
| HIF-1α-2681 21 nt Targ: | 5'-TCTTGGAAACGTGTAAAAGGA-3' | (SEQ ID NO: 4870) |
| HIF-1α-2692 21 nt Targ: | 5'-TGTAAAAGGATGCAAATCTAG-3' | (SEQ ID NO: 4871) |
| HIF-1α-2693 21 nt Targ: | 5'-GTAAAAGGATGCAAATCTAGT-3' | (SEQ ID NO: 4872) |
| HIF-1α-2698 21 nt Targ: | 5'-AGGATGCAAATCTAGTGAACA-3' | (SEQ ID NO: 4873) |
| HIF-1α-2702 21 nt Targ: | 5'-TGCAAATCTAGTGAACAGAAT-3' | (SEQ ID NO: 4874) |
| HIF-1α-2708 21 nt Targ: | 5'-TCTAGTGAACAGAATGGAATG-3' | (SEQ ID NO: 4875) |
| HIF-1α-2709 21 nt Targ: | 5'-CTAGTGAACAGAATGGAATGG-3' | (SEQ ID NO: 4876) |
| HIF-1α-2716 21 nt Targ: | 5'-ACAGAATGGAATGGAGCAAAA-3' | (SEQ ID NO: 4877) |
| HIF-1α-2721 21 nt Targ: | 5'-ATGGAATGGAGCAAAAGACAA-3' | (SEQ ID NO: 4878) |
| HIF-1α-2723 21 nt Targ: | 5'-GGAATGGAGCAAAAGACAATT-3' | (SEQ ID NO: 4879) |
| HIF-1α-2724 21 nt Targ: | 5'-GAATGGAGCAAAAGACAATTA-3' | (SEQ ID NO: 4880) |
| HIF-1α-2725 21 nt Targ: | 5'-AATGGAGCAAAAGACAATTAT-3' | (SEQ ID NO: 4881) |
| HIF-1α-2726 21 nt Targ: | 5'-ATGGAGCAAAAGACAATTATT-3' | (SEQ ID NO: 4882) |
| HIF-1α-2738 21 nt Targ: | 5'-ACAATTATTTTAATACCCTCT-3' | (SEQ ID NO: 4883) |
| HIF-1α-2739 21 nt Targ: | 5'-CAATTATTTTAATACCCTCTG-3' | (SEQ ID NO: 4884) |
| HIF-1α-2740 21 nt Targ: | 5'-AATTATTTTAATACCCTCTGA-3' | (SEQ ID NO: 4885) |
| HIF-1α-2742 21 nt Targ: | 5'-TTATTTTAATACCCTCTGATT-3' | (SEQ ID NO: 4886) |
| HIF-1α-2743 21 nt Targ: | 5'-TATTTTAATACCCTCTGATTT-3' | (SEQ ID NO: 4887) |
| HIF-1α-2776 21 nt Targ: | 5'-GCTGGGGCAATCAATGGATGA-3' | (SEQ ID NO: 4888) |
| HIF-1α-2781 21 nt Targ: | 5'-GGCAATCAATGGATGAAAGTG-3' | (SEQ ID NO: 4889) |
| HIF-1α-2817 21 nt Targ: | 5'-CCAGTTATGATTGTGAAGTTA-3' | (SEQ ID NO: 4890) |
| HIF-1α-2818 21 nt Targ: | 5'-CAGTTATGATTGTGAAGTTAA-3' | (SEQ ID NO: 4891) |
| HIF-1α-2826 21 nt Targ: | 5'-ATTGTGAAGTTAATGCTCCTA-3' | (SEQ ID NO: 4892) |
| HIF-1α-2830 21 nt Targ: | 5'-TGAAGTTAATGCTCCTATACA-3' | (SEQ ID NO: 4893) |
| HIF-1α-2869 21 nt Targ: | 5'-GCAGGGTGAAGAATTACTCAG-3' | (SEQ ID NO: 4894) |
| HIF-1α-2875 21 nt Targ: | 5'-TGAAGAATTACTCAGAGCTTT-3' | (SEQ ID NO: 4895) |
| HIF-1α-2877 21 nt Targ: | 5'-AAGAATTACTCAGAGCTTTGG-3' | (SEQ ID NO: 4896) |
| HIF-1α-2885 21 nt Targ: | 5'-CTCAGAGCTTTGGATCAAGTT-3' | (SEQ ID NO: 4897) |
| HIF-1α-2900 21 nt Targ: | 5'-CAAGTTAACTGAGCTTTTTCT-3' | (SEQ ID NO: 4898) |

TABLE 5-continued

DsiRNA Target Sequences (21mers) In HIF-1α mRNA

| | | | |
|---|---|---|---|
| HIF-1α-2902 21 nt Targ: | 5'-AGTTAACTGAGCTTTTTCTTA-3' | (SEQ ID NO: 4899) |
| HIF-1α-2913 21 nt Targ: | 5'-CTTTTTCTTAATTTCATTCCT-3' | (SEQ ID NO: 4900) |
| HIF-1α-2918 21 nt Targ: | 5'-TCTTAATTTCATTCCTTTTTT-3' | (SEQ ID NO: 4901) |
| HIF-1α-2920 21 nt Targ: | 5'-TTAATTTCATTCCTTTTTTG-3' | (SEQ ID NO: 4902) |
| HIF-1α-2943 21 nt Targ: | 5'-CACTGGTGGCTCATTACCTAA-3' | (SEQ ID NO: 4903) |
| HIF-1α-2952 21 nt Targ: | 5'-CTCATTACCTAAAGCAGTCTA-3' | (SEQ ID NO: 4904) |
| HIF-1α-2953 21 nt Targ: | 5'-TCATTACCTAAAGCAGTCTAT-3' | (SEQ ID NO: 4905) |
| HIF-1α-2958 21 nt Targ: | 5'-ACCTAAAGCAGTCTATTTATA-3' | (SEQ ID NO: 4906) |
| HIF-1α-2960 21 nt Targ: | 5'-CTAAAGCAGTCTATTTATATT-3' | (SEQ ID NO: 4907) |
| HIF-1α-2971 21 nt Targ: | 5'-TATTTATATTTTCTACATCTA-3' | (SEQ ID NO: 4908) |
| HIF-1α-2972 21 nt Targ: | 5'-ATTTATATTTTCTACATCTAA-3' | (SEQ ID NO: 4909) |
| HIF-1α-2973 21 nt Targ: | 5'-TTTATATTTTCTACATCTAAT-3' | (SEQ ID NO: 4910) |
| HIF-1α-2975 21 nt Targ: | 5'-TATATTTTCTACATCTAATTT-3' | (SEQ ID NO: 4911) |
| HIF-1α-2976 21 nt Targ: | 5'-ATATTTTCTACATCTAATTTT-3' | (SEQ ID NO: 4912) |
| HIF-1α-3001 21 nt Targ: | 5'-GCCTGGCTACAATACTGCACA-3' | (SEQ ID NO: 4913) |
| HIF-1α-3022 21 nt Targ: | 5'-AACTTGGTTAGTTCAATTTTG-3' | (SEQ ID NO: 4914) |
| HIF-1α-3029 21 nt Targ: | 5'-TTAGTTCAATTTTGATCCCCT-3' | (SEQ ID NO: 4915) |
| HIF-1α-3037 21 nt Targ: | 5'-ATTTTGATCCCCTTTCTACTT-3' | (SEQ ID NO: 4916) |
| HIF-1α-3038 21 nt Targ: | 5'-TTTTGATCCCCTTTCTACTTA-3' | (SEQ ID NO: 4917) |
| HIF-1α-3039 21 nt Targ: | 5'-TTTGATCCCCTTTCTACTTAA-3' | (SEQ ID NO: 4918) |
| HIF-1α-3046 21 nt Targ: | 5'-CCCTTTCTACTTAATTTACAT-3' | (SEQ ID NO: 4919) |
| HIF-1α-3056 21 nt Targ: | 5'-TTAATTTACATTAATGCTCTT-3' | (SEQ ID NO: 4920) |
| HIF-1α-3057 21 nt Targ: | 5'-TAATTTACATTAATGCTCTTT-3' | (SEQ ID NO: 4921) |
| HIF-1α-3063 21 nt Targ: | 5'-ACATTAATGCTCTTTTTTAGT-3' | (SEQ ID NO: 4922) |
| HIF-1α-3064 21 nt Targ: | 5'-CATTAATGCTCTTTTTTAGTA-3' | (SEQ ID NO: 4923) |
| HIF-1α-3066 21 nt Targ: | 5'-TTAATGCTCTTTTTTAGTATG-3' | (SEQ ID NO: 4924) |
| HIF-1α-3074 21 nt Targ: | 5'-CTTTTTTAGTATGTTCTTTAA-3' | (SEQ ID NO: 4925) |
| HIF-1α-3078 21 nt Targ: | 5'-TTTAGTATGTTCTTTAATGCT-3' | (SEQ ID NO: 4926) |
| HIF-1α-3079 21 nt Targ: | 5'-TTAGTATGTTCTTTAATGCTG-3' | (SEQ ID NO: 4927) |
| HIF-1α-3080 21 nt Targ: | 5'-TAGTATGTTCTTTAATGCTGG-3' | (SEQ ID NO: 4928) |
| HIF-1α-3103 21 nt Targ: | 5'-CACAGACAGCTCATTTTCTCA-3' | (SEQ ID NO: 4929) |
| HIF-1α-3112 21 nt Targ: | 5'-CTCATTTTCTCAGTTTTTTGG-3' | (SEQ ID NO: 4930) |
| HIF-1α-3113 21 nt Targ: | 5'-TCATTTTCTCAGTTTTTTGGT-3' | (SEQ ID NO: 4931) |
| HIF-1α-3114 21 nt Targ: | 5'-CATTTTCTCAGTTTTTTGGTA-3' | (SEQ ID NO: 4932) |
| HIF-1α-3124 21 nt Targ: | 5'-GTTTTTTGGTATTTAAACCAT-3' | (SEQ ID NO: 4933) |
| HIF-1α-3128 21 nt Targ: | 5'-TTTGGTATTTAAACCATTGCA-3' | (SEQ ID NO: 4934) |
| HIF-1α-3129 21 nt Targ: | 5'-TTGGTATTTAAACCATTGCAT-3' | (SEQ ID NO: 4935) |
| HIF-1α-3134 21 nt Targ: | 5'-ATTTAAACCATTGCATTGCAG-3' | (SEQ ID NO: 4936) |
| HIF-1α-3146 21 nt Targ: | 5'-GCATTGCAGTAGCATCATTTT-3' | (SEQ ID NO: 4937) |

TABLE 5-continued

DsiRNA Target Sequences (21mers) In HIF-1α mRNA

| | | | |
|---|---|---|---|
| HIF-1α-3151 21 nt Targ: | 5'-GCAGTAGCATCATTTTAAAAA-3' | (SEQ ID NO: 4938) |
| HIF-1α-3152 21 nt Targ: | 5'-CAGTAGCATCATTTTAAAAAA-3' | (SEQ ID NO: 4939) |
| HIF-1α-3159 21 nt Targ: | 5'-ATCATTTTAAAAAATGCACCT-3' | (SEQ ID NO: 4940) |
| HIF-1α-3160 21 nt Targ: | 5'-TCATTTTAAAAAATGCACCTT-3' | (SEQ ID NO: 4941) |
| HIF-1α-3161 21 nt Targ: | 5'-CATTTTAAAAAATGCACCTTT-3' | (SEQ ID NO: 4942) |
| HIF-1α-3162 21 nt Targ: | 5'-ATTTTAAAAAATGCACCTTTT-3' | (SEQ ID NO: 4943) |
| HIF-1α-3163 21 nt Targ: | 5'-TTTTAAAAAATGCACCTTTTT-3' | (SEQ ID NO: 4944) |
| HIF-1α-3164 21 nt Targ: | 5'-TTTAAAAAATGCACCTTTTTA-3' | (SEQ ID NO: 4945) |
| HIF-1α-3166 21 nt Targ: | 5'-TAAAAAATGCACCTTTTTATT-3' | (SEQ ID NO: 4946) |
| HIF-1α-3168 21 nt Targ: | 5'-AAAAATGCACCTTTTTATTTA-3' | (SEQ ID NO: 4947) |
| HIF-1α-3176 21 nt Targ: | 5'-ACCTTTTTATTTATTTATTTT-3' | (SEQ ID NO: 4948) |
| HIF-1α-3182 21 nt Targ: | 5'-TTATTTATTTATTTTTGGCTA-3' | (SEQ ID NO: 4949) |
| HIF-1α-3184 21 nt Targ: | 5'-ATTTATTTATTTTTGGCTAGG-3' | (SEQ ID NO: 4950) |
| HIF-1α-3185 21 nt Targ: | 5'-TTTATTTATTTTTGGCTAGGG-3' | (SEQ ID NO: 4951) |
| HIF-1α-3186 21 nt Targ: | 5'-TTATTTATTTTTGGCTAGGGA-3' | (SEQ ID NO: 4952) |
| HIF-1α-3187 21 nt Targ: | 5'-TATTTATTTTTGGCTAGGGAG-3' | (SEQ ID NO: 4953) |
| HIF-1α-3202 21 nt Targ: | 5'-AGGGAGTTTATCCCTTTTTCG-3' | (SEQ ID NO: 4954) |
| HIF-1α-3203 21 nt Targ: | 5'-GGGAGTTTATCCCTTTTTCGA-3' | (SEQ ID NO: 4955) |
| HIF-1α-3204 21 nt Targ: | 5'-GGAGTTTATCCCTTTTTCGAA-3' | (SEQ ID NO: 4956) |
| HIF-1α-3205 21 nt Targ: | 5'-GAGTTTATCCCTTTTTCGAAT-3' | (SEQ ID NO: 4957) |
| HIF-1α-3206 21 nt Targ: | 5'-AGTTTATCCCTTTTTCGAATT-3' | (SEQ ID NO: 4958) |
| HIF-1α-3207 21 nt Targ: | 5'-GTTTATCCCTTTTTCGAATTA-3' | (SEQ ID NO: 4959) |
| HIF-1α-3219 21 nt Targ: | 5'-TTCGAATTATTTTTAAGAAGA-3' | (SEQ ID NO: 4960) |
| HIF-1α-3224 21 nt Targ: | 5'-ATTATTTTTAAGAAGATGCCA-3' | (SEQ ID NO: 4961) |
| HIF-1α-3225 21 nt Targ: | 5'-TTATTTTTAAGAAGATGCCAA-3' | (SEQ ID NO: 4962) |
| HIF-1α-3227 21 nt Targ: | 5'-ATTTTTAAGAAGATGCCAATA-3' | (SEQ ID NO: 4963) |
| HIF-1α-3228 21 nt Targ: | 5'-TTTTTAAGAAGATGCCAATAT-3' | (SEQ ID NO: 4964) |
| HIF-1α-3230 21 nt Targ: | 5'-TTTAAGAAGATGCCAATATAA-3' | (SEQ ID NO: 4965) |
| HIF-1α-3231 21 nt Targ: | 5'-TTAAGAAGATGCCAATATAAT-3' | (SEQ ID NO: 4966) |
| HIF-1α-3233 21 nt Targ: | 5'-AAGAAGATGCCAATATAATTT-3' | (SEQ ID NO: 4967) |
| HIF-1α-3234 21 nt Targ: | 5'-AGAAGATGCCAATATAATTTT-3' | (SEQ ID NO: 4968) |
| HIF-1α-3235 21 nt Targ: | 5'-GAAGATGCCAATATAATTTTT-3' | (SEQ ID NO: 4969) |
| HIF-1α-3242 21 nt Targ: | 5'-CCAATATAATTTTGTAAGAA-3' | (SEQ ID NO: 4970) |
| HIF-1α-3246 21 nt Targ: | 5'-TATAATTTTGTAAGAAGGCA-3' | (SEQ ID NO: 4971) |
| HIF-1α-3248 21 nt Targ: | 5'-TAATTTTGTAAGAAGGCAGT-3' | (SEQ ID NO: 4972) |
| HIF-1α-3277 21 nt Targ: | 5'-ATCATGATCATAGGCAGTTGA-3' | (SEQ ID NO: 4973) |
| HIF-1α-3279 21 nt Targ: | 5'-CATGATCATAGGCAGTTGAAA-3' | (SEQ ID NO: 4974) |
| HIF-1α-3283 21 nt Targ: | 5'-ATCATAGGCAGTTGAAAAATT-3' | (SEQ ID NO: 4975) |
| HIF-1α-3285 21 nt Targ: | 5'-CATAGGCAGTTGAAAAATTTT-3' | (SEQ ID NO: 4976) |

TABLE 5-continued

DsiRNA Target Sequences (21mers) In HIF-1α mRNA

| | | | |
|---|---|---|---|
| HIF-1α-3293 21 nt Targ: | 5'-GTTGAAAAATTTTTACACCTT-3' | (SEQ ID NO: 4977) |
| HIF-1α-3294 21 nt Targ: | 5'-TTGAAAAATTTTTACACCTTT-3' | (SEQ ID NO: 4978) |
| HIF-1α-3295 21 nt Targ: | 5'-TGAAAAATTTTTACACCTTTT-3' | (SEQ ID NO: 4979) |
| HIF-1α-3296 21 nt Targ: | 5'-GAAAAATTTTTACACCTTTTT-3' | (SEQ ID NO: 4980) |
| HIF-1α-3297 21 nt Targ: | 5'-AAAAATTTTTACACCTTTTTT-3' | (SEQ ID NO: 4981) |
| HIF-1α-3311 21 nt Targ: | 5'-CTTTTTTTTCACATTTTACAT-3' | (SEQ ID NO: 4982) |
| HIF-1α-3312 21 nt Targ: | 5'-TTTTTTTTCACATTTTACATA-3' | (SEQ ID NO: 4983) |
| HIF-1α-3313 21 nt Targ: | 5'-TTTTTTTCACATTTTACATAA-3' | (SEQ ID NO: 4984) |
| HIF-1α-3314 21 nt Targ: | 5'-TTTTTTCACATTTTACATAAA-3' | (SEQ ID NO: 4985) |
| HIF-1α-3320 21 nt Targ: | 5'-CACATTTTACATAAATAATAA-3' | (SEQ ID NO: 4986) |
| HIF-1α-3359 21 nt Targ: | 5'-TGGTAGCCACAATTGCACAAT-3' | (SEQ ID NO: 4987) |
| HIF-1α-3375 21 nt Targ: | 5'-ACAATATATTTTCTTAAAAAA-3' | (SEQ ID NO: 4988) |
| HIF-1α-3385 21 nt Targ: | 5'-TTCTTAAAAAATACCAGCAGT-3' | (SEQ ID NO: 4989) |
| HIF-1α-3400 21 nt Targ: | 5'-AGCAGTTACTCATGGAATATA-3' | (SEQ ID NO: 4990) |
| HIF-1α-3408 21 nt Targ: | 5'-CTCATGGAATATATTCTGCGT-3' | (SEQ ID NO: 4991) |
| HIF-1α-3409 21 nt Targ: | 5'-TCATGGAATATATTCTGCGTT-3' | (SEQ ID NO: 4992) |
| HIF-1α-3410 21 nt Targ: | 5'-CATGGAATATATTCTGCGTTT-3' | (SEQ ID NO: 4993) |
| HIF-1α-3411 21 nt Targ: | 5'-ATGGAATATATTCTGCGTTTA-3' | (SEQ ID NO: 4994) |
| HIF-1α-3412 21 nt Targ: | 5'-TGGAATATATTCTGCGTTTAT-3' | (SEQ ID NO: 4995) |
| HIF-1α-3413 21 nt Targ: | 5'-GGAATATATTCTGCGTTTATA-3' | (SEQ ID NO: 4996) |
| HIF-1α-3414 21 nt Targ: | 5'-GAATATATTCTGCGTTTATAA-3' | (SEQ ID NO: 4997) |
| HIF-1α-3429 21 nt Targ: | 5'-TTATAAAACTAGTTTTTAAGA-3' | (SEQ ID NO: 4998) |
| HIF-1α-3435 21 nt Targ: | 5'-AACTAGTTTTTAAGAAGAAAT-3' | (SEQ ID NO: 4999) |
| HIF-1α-3436 21 nt Targ: | 5'-ACTAGTTTTTAAGAAGAAATT-3' | (SEQ ID NO: 5000) |
| HIF-1α-3437 21 nt Targ: | 5'-CTAGTTTTTAAGAAGAAATTT-3' | (SEQ ID NO: 5001) |
| HIF-1α-3438 21 nt Targ: | 5'-TAGTTTTTAAGAAGAAATTTT-3' | (SEQ ID NO: 5002) |
| HIF-1α-3441 21 nt Targ: | 5'-TTTTTAAGAAGAAATTTTTTT-3' | (SEQ ID NO: 5003) |
| HIF-1α-3447 21 nt Targ: | 5'-AGAAGAAATTTTTTTGGCCT-3' | (SEQ ID NO: 5004) |
| HIF-1α-3449 21 nt Targ: | 5'-AAGAAATTTTTTTGGCCTAT-3' | (SEQ ID NO: 5005) |
| HIF-1α-3451 21 nt Targ: | 5'-GAAATTTTTTTGGCCTATGA-3' | (SEQ ID NO: 5006) |
| HIF-1α-3453 21 nt Targ: | 5'-AATTTTTTTGGCCTATGAAA-3' | (SEQ ID NO: 5007) |
| HIF-1α-3456 21 nt Targ: | 5'-TTTTTTTGGCCTATGAAATTG-3' | (SEQ ID NO: 5008) |
| HIF-1α-3457 21 nt Targ: | 5'-TTTTTTGGCCTATGAAATTGT-3' | (SEQ ID NO: 5009) |
| HIF-1α-3458 21 nt Targ: | 5'-TTTTTGGCCTATGAAATTGTT-3' | (SEQ ID NO: 5010) |
| HIF-1α-3459 21 nt Targ: | 5'-TTTTGGCCTATGAAATTGTTA-3' | (SEQ ID NO: 5011) |
| HIF-1α-3464 21 nt Targ: | 5'-GCCTATGAAATTGTTAAACCT-3' | (SEQ ID NO: 5012) |
| HIF-1α-3466 21 nt Targ: | 5'-CTATGAAATTGTTAAACCTGG-3' | (SEQ ID NO: 5013) |
| HIF-1α-3470 21 nt Targ: | 5'-GAAATTGTTAAACCTGGAACA-3' | (SEQ ID NO: 5014) |
| HIF-1α-3471 21 nt Targ: | 5'-AAATTGTTAAACCTGGAACAT-3' | (SEQ ID NO: 5015) |

TABLE 5-continued

DsiRNA Target Sequences (21mers) In HIF-1α mRNA

| | | |
|---|---|---|
| HIF-1α-3481 21 nt Targ: | 5'-ACCTGGAACATGACATTGTTA-3' | (SEQ ID NO: 5016) |
| HIF-1α-3487 21 nt Targ: | 5'-AACATGACATTGTTAATCATA-3' | (SEQ ID NO: 5017) |
| HIF-1α-3488 21 nt Targ: | 5'-ACATGACATTGTTAATCATAT-3' | (SEQ ID NO: 5018) |
| HIF-1α-3492 21 nt Targ: | 5'-GACATTGTTAATCATATAATA-3' | (SEQ ID NO: 5019) |
| HIF-1α-3494 21 nt Targ: | 5'-CATTGTTAATCATATAATAAT-3' | (SEQ ID NO: 5020) |
| HIF-1α-3495 21 nt Targ: | 5'-ATTGTTAATCATATAATAATG-3' | (SEQ ID NO: 5021) |
| HIF-1α-3496 21 nt Targ: | 5'-TTGTTAATCATATAATAATGA-3' | (SEQ ID NO: 5022) |
| HIF-1α-3503 21 nt Targ: | 5'-TCATATAATAATGATTCTTAA-3' | (SEQ ID NO: 5023) |
| HIF-1α-3504 21 nt Targ: | 5'-CATATAATAATGATTCTTAAA-3' | (SEQ ID NO: 5024) |
| HIF-1α-3508 21 nt Targ: | 5'-TAATAATGATTCTTAAATGCT-3' | (SEQ ID NO: 5025) |
| HIF-1α-3511 21 nt Targ: | 5'-TAATGATTCTTAAATGCTGTA-3' | (SEQ ID NO: 5026) |
| HIF-1α-3512 21 nt Targ: | 5'-AATGATTCTTAAATGCTGTAT-3' | (SEQ ID NO: 5027) |
| HIF-1α-3513 21 nt Targ: | 5'-ATGATTCTTAAATGCTGTATG-3' | (SEQ ID NO: 5028) |
| HIF-1α-3518 21 nt Targ: | 5'-TCTTAAATGCTGTATGGTTTA-3' | (SEQ ID NO: 5029) |
| HIF-1α-3519 21 nt Targ: | 5'-CTTAAATGCTGTATGGTTTAT-3' | (SEQ ID NO: 5030) |
| HIF-1α-3521 21 nt Targ: | 5'-TAAATGCTGTATGGTTTATTA-3' | (SEQ ID NO: 5031) |
| HIF-1α-3528 21 nt Targ: | 5'-TGTATGGTTTATTATTTAAAT-3' | (SEQ ID NO: 5032) |
| HIF-1α-3530 21 nt Targ: | 5'-TATGGTTTATTATTTAAATGG-3' | (SEQ ID NO: 5033) |
| HIF-1α-3531 21 nt Targ: | 5'-ATGGTTTATTATTTAAATGGG-3' | (SEQ ID NO: 5034) |
| HIF-1α-3533 21 nt Targ: | 5'-GGTTTATTATTTAAATGGGTA-3' | (SEQ ID NO: 5035) |
| HIF-1α-3534 21 nt Targ: | 5'-GTTTATTATTTAAATGGGTAA-3' | (SEQ ID NO: 5036) |
| HIF-1α-3539 21 nt Targ: | 5'-TTATTTAAATGGGTAAAGCCA-3' | (SEQ ID NO: 5037) |
| HIF-1α-3545 21 nt Targ: | 5'-AAATGGGTAAAGCCATTTACA-3' | (SEQ ID NO: 5038) |
| HIF-1α-3548 21 nt Targ: | 5'-TGGGTAAAGCCATTTACATAA-3' | (SEQ ID NO: 5039) |
| HIF-1α-3550 21 nt Targ: | 5'-GGTAAAGCCATTTACATAATA-3' | (SEQ ID NO: 5040) |
| HIF-1α-3551 21 nt Targ: | 5'-GTAAAGCCATTTACATAATAT-3' | (SEQ ID NO: 5041) |
| HIF-1α-3556 21 nt Targ: | 5'-GCCATTTACATAATATAGAAA-3' | (SEQ ID NO: 5042) |
| HIF-1α-3565 21 nt Targ: | 5'-ATAATATAGAAAGATATGCAT-3' | (SEQ ID NO: 5043) |
| HIF-1α-3566 21 nt Targ: | 5'-TAATATAGAAAGATATGCATA-3' | (SEQ ID NO: 5044) |
| HIF-1α-3567 21 nt Targ: | 5'-AATATAGAAAGATATGCATAT-3' | (SEQ ID NO: 5045) |
| HIF-1α-3571 21 nt Targ: | 5'-TAGAAAGATATGCATATATCT-3' | (SEQ ID NO: 5046) |
| HIF-1α-3574 21 nt Targ: | 5'-AAAGATATGCATATATCTAGA-3' | (SEQ ID NO: 5047) |
| HIF-1α-3575 21 nt Targ: | 5'-AAGATATGCATATATCTAGAA-3' | (SEQ ID NO: 5048) |
| HIF-1α-3576 21 nt Targ: | 5'-AGATATGCATATATCTAGAAG-3' | (SEQ ID NO: 5049) |
| HIF-1α-3581 21 nt Targ: | 5'-TGCATATATCTAGAAGGTATG-3' | (SEQ ID NO: 5050) |
| HIF-1α-3582 21 nt Targ: | 5'-GCATATATCTAGAAGGTATGT-3' | (SEQ ID NO: 5051) |
| HIF-1α-3589 21 nt Targ: | 5'-TCTAGAAGGTATGTGGCATTT-3' | (SEQ ID NO: 5052) |
| HIF-1α-3593 21 nt Targ: | 5'-GAAGGTATGTGGCATTTATTT-3' | (SEQ ID NO: 5053) |
| HIF-1α-3597 21 nt Targ: | 5'-GTATGTGGCATTTATTTGGAT-3' | (SEQ ID NO: 5054) |

TABLE 5-continued

DsiRNA Target Sequences (21mers) In HIF-1α mRNA

| | | | |
|---|---|---|---|
| HIF-1α-3599 21 nt Targ: | 5'-ATGTGGCATTTATTTGGATAA-3' | (SEQ ID NO: 5055) |
| HIF-1α-3607 21 nt Targ: | 5'-TTTATTTGGATAAAATTCTCA-3' | (SEQ ID NO: 5056) |
| HIF-1α-3613 21 nt Targ: | 5'-TGGATAAAATTCTCAATTCAG-3' | (SEQ ID NO: 5057) |
| HIF-1α-3615 21 nt Targ: | 5'-GATAAAATTCTCAATTCAGAG-3' | (SEQ ID NO: 5058) |
| HIF-1α-3617 21 nt Targ: | 5'-TAAAATTCTCAATTCAGAGAA-3' | (SEQ ID NO: 5059) |
| HIF-1α-3625 21 nt Targ: | 5'-TCAATTCAGAGAAATCATCTG-3' | (SEQ ID NO: 5060) |
| HIF-1α-3629 21 nt Targ: | 5'-TTCAGAGAAATCATCTGATGT-3' | (SEQ ID NO: 5061) |
| HIF-1α-3634 21 nt Targ: | 5'-AGAAATCATCTGATGTTTCTA-3' | (SEQ ID NO: 5062) |
| HIF-1α-3642 21 nt Targ: | 5'-TCTGATGTTTCTATAGTCACT-3' | (SEQ ID NO: 5063) |
| HIF-1α-3643 21 nt Targ: | 5'-CTGATGTTTCTATAGTCACTT-3' | (SEQ ID NO: 5064) |
| HIF-1α-3671 21 nt Targ: | 5'-TCAAAAGAAAACAATACCCTA-3' | (SEQ ID NO: 5065) |
| HIF-1α-3673 21 nt Targ: | 5'-AAAAGAAAACAATACCCTATG-3' | (SEQ ID NO: 5066) |
| HIF-1α-3674 21 nt Targ: | 5'-AAAGAAAACAATACCCTATGT-3' | (SEQ ID NO: 5067) |
| HIF-1α-3676 21 nt Targ: | 5'-AGAAAACAATACCCTATGTAG-3' | (SEQ ID NO: 5068) |
| HIF-1α-3680 21 nt Targ: | 5'-AACAATACCCTATGTAGTTGT-3' | (SEQ ID NO: 5069) |
| HIF-1α-3688 21 nt Targ: | 5'-CCTATGTAGTTGTGGAAGTTT-3' | (SEQ ID NO: 5070) |
| HIF-1α-3689 21 nt Targ: | 5'-CTATGTAGTTGTGGAAGTTTA-3' | (SEQ ID NO: 5071) |
| HIF-1α-3694 21 nt Targ: | 5'-TAGTTGTGGAAGTTTATGCTA-3' | (SEQ ID NO: 5072) |
| HIF-1α-3695 21 nt Targ: | 5'-AGTTGTGGAAGTTTATGCTAA-3' | (SEQ ID NO: 5073) |
| HIF-1α-3697 21 nt Targ: | 5'-TTGTGGAAGTTTATGCTAATA-3' | (SEQ ID NO: 5074) |
| HIF-1α-3699 21 nt Targ: | 5'-GTGGAAGTTTATGCTAATATT-3' | (SEQ ID NO: 5075) |
| HIF-1α-3700 21 nt Targ: | 5'-TGGAAGTTTATGCTAATATTG-3' | (SEQ ID NO: 5076) |
| HIF-1α-3701 21 nt Targ: | 5'-GGAAGTTTATGCTAATATTGT-3' | (SEQ ID NO: 5077) |
| HIF-1α-3703 21 nt Targ: | 5'-AAGTTTATGCTAATATTGTGT-3' | (SEQ ID NO: 5078) |
| HIF-1α-3710 21 nt Targ: | 5'-TGCTAATATTGTGTAACTGAT-3' | (SEQ ID NO: 5079) |
| HIF-1α-3712 21 nt Targ: | 5'-CTAATATTGTGTAACTGATAT-3' | (SEQ ID NO: 5080) |
| HIF-1α-3714 21 nt Targ: | 5'-AATATTGTGTAACTGATATTA-3' | (SEQ ID NO: 5081) |
| HIF-1α-3724 21 nt Targ: | 5'-AACTGATATTAAACCTAAATG-3' | (SEQ ID NO: 5082) |
| HIF-1α-3756 21 nt Targ: | 5'-CTGTTGGTATAAAGATATTTT-3' | (SEQ ID NO: 5083) |
| HIF-1α-3761 21 nt Targ: | 5'-GGTATAAAGATATTTTGAGCA-3' | (SEQ ID NO: 5084) |
| HIF-1α-3765 21 nt Targ: | 5'-TAAAGATATTTTGAGCAGACT-3' | (SEQ ID NO: 5085) |
| HIF-1α-3766 21 nt Targ: | 5'-AAAGATATTTTGAGCAGACTG-3' | (SEQ ID NO: 5086) |
| HIF-1α-3767 21 nt Targ: | 5'-AAGATATTTTGAGCAGACTGT-3' | (SEQ ID NO: 5087) |
| HIF-1α-3772 21 nt Targ: | 5'-ATTTTGAGCAGACTGTAAACA-3' | (SEQ ID NO: 5088) |
| HIF-1α-3774 21 nt Targ: | 5'-TTTGAGCAGACTGTAAACAAG-3' | (SEQ ID NO: 5089) |
| HIF-1α-3778 21 nt Targ: | 5'-AGCAGACTGTAAACAAGAAA-3' | (SEQ ID NO: 5090) |
| HIF-1α-3782 21 nt Targ: | 5'-GACTGTAAACAAGAAAAAAAA-3' | (SEQ ID NO: 5091) |
| HIF-1α-3783 21 nt Targ: | 5'-ACTGTAAACAAGAAAAAAAAA-3' | (SEQ ID NO: 5092) |
| HIF-1α-3795 21 nt Targ: | 5'-AAAAAAAAAATCATGCATTCT-3' | (SEQ ID NO: 5093) |

TABLE 5-continued

DsiRNA Target Sequences (21mers) In HIF-1α mRNA

| | | |
|---|---|---|
| HIF-1α-3796 21 nt Targ: | 5'-AAAAAAAAATCATGCATTCTT-3' | (SEQ ID NO: 5094) |
| HIF-1α-3804 21 nt Targ: | 5'-ATCATGCATTCTTAGCAAAAT-3' | (SEQ ID NO: 5095) |
| HIF-1α-3812 21 nt Targ: | 5'-TTCTTAGCAAAATTGCCTAGT-3' | (SEQ ID NO: 5096) |
| HIF-1α-3813 21 nt Targ: | 5'-TCTTAGCAAAATTGCCTAGTA-3' | (SEQ ID NO: 5097) |
| HIF-1α-3818 21 nt Targ: | 5'-GCAAAATTGCCTAGTATGTTA-3' | (SEQ ID NO: 5098) |
| HIF-1α-3820 21 nt Targ: | 5'-AAAATTGCCTAGTATGTTAAT-3' | (SEQ ID NO: 5099) |
| HIF-1α-3821 21 nt Targ: | 5'-AAATTGCCTAGTATGTTAATT-3' | (SEQ ID NO: 5100) |
| HIF-1α-3827 21 nt Targ: | 5'-CCTAGTATGTTAATTTGCTCA-3' | (SEQ ID NO: 5101) |
| HIF-1α-3828 21 nt Targ: | 5'-CTAGTATGTTAATTTGCTCAA-3' | (SEQ ID NO: 5102) |
| HIF-1α-3829 21 nt Targ: | 5'-TAGTATGTTAATTTGCTCAAA-3' | (SEQ ID NO: 5103) |
| HIF-1α-3835 21 nt Targ: | 5'-GTTAATTTGCTCAAAATACAA-3' | (SEQ ID NO: 5104) |
| HIF-1α-3836 21 nt Targ: | 5'-TTAATTTGCTCAAAATACAAT-3' | (SEQ ID NO: 5105) |
| HIF-1α-3838 21 nt Targ: | 5'-AATTTGCTCAAAATACAATGT-3' | (SEQ ID NO: 5106) |
| HIF-1α-3844 21 nt Targ: | 5'-CTCAAAATACAATGTTTGATT-3' | (SEQ ID NO: 5107) |
| HIF-1α-3846 21 nt Targ: | 5'-CAAAATACAATGTTTGATTTT-3' | (SEQ ID NO: 5108) |
| HIF-1α-3847 21 nt Targ: | 5'-AAAATACAATGTTTGATTTTA-3' | (SEQ ID NO: 5109) |
| HIF-1α-3853 21 nt Targ: | 5'-CAATGTTTGATTTTATGCACT-3' | (SEQ ID NO: 5110) |
| HIF-1α-3854 21 nt Targ: | 5'-AATGTTTGATTTTATGCACTT-3' | (SEQ ID NO: 5111) |
| HIF-1α-3864 21 nt Targ: | 5'-TTTATGCACTTTGTCGCTATT-3' | (SEQ ID NO: 5112) |
| HIF-1α-3872 21 nt Targ: | 5'-CTTTGTCGCTATTAACATCCT-3' | (SEQ ID NO: 5113) |
| HIF-1α-3891 21 nt Targ: | 5'-CTTTTTTTCATGTAGATTTCA-3' | (SEQ ID NO: 5114) |
| HIF-1α-3892 21 nt Targ: | 5'-TTTTTTTCATGTAGATTTCAA-3' | (SEQ ID NO: 5115) |
| HIF-1α-3897 21 nt Targ: | 5'-TTCATGTAGATTTCAATAATT-3' | (SEQ ID NO: 5116) |
| HIF-1α-3898 21 nt Targ: | 5'-TCATGTAGATTTCAATAATTG-3' | (SEQ ID NO: 5117) |
| HIF-1α-3899 21 nt Targ: | 5'-CATGTAGATTTCAATAATTGA-3' | (SEQ ID NO: 5118) |
| HIF-1α-3900 21 nt Targ: | 5'-ATGTAGATTTCAATAATTGAG-3' | (SEQ ID NO: 5119) |
| HIF-1α-3901 21 nt Targ: | 5'-TGTAGATTTCAATAATTGAGT-3' | (SEQ ID NO: 5120) |
| HIF-1α-3902 21 nt Targ: | 5'-GTAGATTTCAATAATTGAGTA-3' | (SEQ ID NO: 5121) |
| HIF-1α-3903 21 nt Targ: | 5'-TAGATTTCAATAATTGAGTAA-3' | (SEQ ID NO: 5122) |
| HIF-1α-3904 21 nt Targ: | 5'-AGATTTCAATAATTGAGTAAT-3' | (SEQ ID NO: 5123) |
| HIF-1α-3910 21 nt Targ: | 5'-CAATAATTGAGTAATTTTAGA-3' | (SEQ ID NO: 5124) |
| HIF-1α-3914 21 nt Targ: | 5'-AATTGAGTAATTTTAGAAGCA-3' | (SEQ ID NO: 5125) |
| HIF-1α-3915 21 nt Targ: | 5'-ATTGAGTAATTTTAGAAGCAT-3' | (SEQ ID NO: 5126) |
| HIF-1α-3917 21 nt Targ: | 5'-TGAGTAATTTTAGAAGCATTA-3' | (SEQ ID NO: 5127) |
| HIF-1α-3921 21 nt Targ: | 5'-TAATTTTAGAAGCATTATTTT-3' | (SEQ ID NO: 5128) |
| HIF-1α-3925 21 nt Targ: | 5'-TTTAGAAGCATTATTTTAGGA-3' | (SEQ ID NO: 5129) |
| HIF-1α-3927 21 nt Targ: | 5'-TAGAAGCATTATTTTAGGAAT-3' | (SEQ ID NO: 5130) |
| HIF-1α-3931 21 nt Targ: | 5'-AGCATTATTTTAGGAATATAT-3' | (SEQ ID NO: 5131) |
| HIF-1α-3933 21 nt Targ: | 5'-CATTATTTTAGGAATATATAG-3' | (SEQ ID NO: 5132) |

TABLE 5-continued

DsiRNA Target Sequences (21mers) In HIF-1α mRNA

| | | |
|---|---|---|
| HIF-1α-3941 21 nt Targ: | 5'-TAGGAATATATAGTTGTCACA-3' | (SEQ ID NO: 5133) |
| HIF-1α-3942 21 nt Targ: | 5'-AGGAATATATAGTTGTCACAG-3' | (SEQ ID NO: 5134) |
| HIF-1α-3943 21 nt Targ: | 5'-GGAATATATAGTTGTCACAGT-3' | (SEQ ID NO: 5135) |
| HIF-1α-3945 21 nt Targ: | 5'-AATATATAGTTGTCACAGTAA-3' | (SEQ ID NO: 5136) |
| HIF-1α-3946 21 nt Targ: | 5'-ATATATAGTTGTCACAGTAAA-3' | (SEQ ID NO: 5137) |
| HIF-1α-3951 21 nt Targ: | 5'-TAGTTGTCACAGTAAATATCT-3' | (SEQ ID NO: 5138) |
| HIF-1α-3952 21 nt Targ: | 5'-AGTTGTCACAGTAAATATCTT-3' | (SEQ ID NO: 5139) |
| HIF-1α-3962 21 nt Targ: | 5'-GTAAATATCTTGTTTTTCTA-3' | (SEQ ID NO: 5140) |
| HIF-1α-3963 21 nt Targ: | 5'-TAAATATCTTGTTTTTCTAT-3' | (SEQ ID NO: 5141) |
| HIF-1α-3968 21 nt Targ: | 5'-ATCTTGTTTTTCTATGTACA-3' | (SEQ ID NO: 5142) |
| HIF-1α-3969 21 nt Targ: | 5'-TCTTGTTTTTCTATGTACAT-3' | (SEQ ID NO: 5143) |
| HIF-1α-3970 21 nt Targ: | 5'-CTTGTTTTTCTATGTACATT-3' | (SEQ ID NO: 5144) |
| HIF-1α-3971 21 nt Targ: | 5'-TTGTTTTTCTATGTACATTG-3' | (SEQ ID NO: 5145) |
| HIF-1α-3978 21 nt Targ: | 5'-TTCTATGTACATTGTACAAAT-3' | (SEQ ID NO: 5146) |
| HIF-1α-3979 21 nt Targ: | 5'-TCTATGTACATTGTACAAATT-3' | (SEQ ID NO: 5147) |
| HIF-1α-3997 21 nt Targ: | 5'-ATTTTTCATTCCTTTTGCTCT-3' | (SEQ ID NO: 5148) |
| HIF-1α-4021 21 nt Targ: | 5'-TGGTTGGATCTAACACTAACT-3' | (SEQ ID NO: 5149) |
| HIF-1α-4022 21 nt Targ: | 5'-GGTTGGATCTAACACTAACTG-3' | (SEQ ID NO: 5150) |
| HIF-1α-4024 21 nt Targ: | 5'-TTGGATCTAACACTAACTGTA-3' | (SEQ ID NO: 5151) |
| HIF-1α-4040 21 nt Targ: | 5'-CTGTATTGTTTTGTTACATCA-3' | (SEQ ID NO: 5152) |
| HIF-1α-4041 21 nt Targ: | 5'-TGTATTGTTTTGTTACATCAA-3' | (SEQ ID NO: 5153) |
| HIF-1α-4042 21 nt Targ: | 5'-GTATTGTTTTGTTACATCAAA-3' | (SEQ ID NO: 5154) |
| HIF-1α-4044 21 nt Targ: | 5'-ATTGTTTTGTTACATCAAATA-3' | (SEQ ID NO: 5155) |
| HIF-1α-4072 21 nt Targ: | 5'-TCTGTGGACCAGGCAAAAAAA-3' | (SEQ ID NO: 5156) |
| HIF-1α-4073 21 nt Targ: | 5'-CTGTGGACCAGGCAAAAAAAA-3' | (SEQ ID NO: 5157) |
| HIF-1α-4079 21 nt Targ: | 5'-ACCAGGCAAAAAAAAAAAAAA-3' | (SEQ ID NO: 5158) |
| HIF-1α-2610t2 21 nt Targ: | 5'-CACTTTTTCAAGCAGTAGGAA-3' | (SEQ ID NO: 5159) |
| HIF-1α-2611t2 21 nt Targ: | 5'-ACTTTTTCAAGCAGTAGGAAT-3' | (SEQ ID NO: 5160) |
| HIF-1α-2616t2 21 nt Targ: | 5'-TTCAAGCAGTAGGAATTATTT-3' | (SEQ ID NO: 5161) |
| HIF-1α-2620t2 21 nt Targ: | 5'-AGCAGTAGGAATTATTTAGCA-3' | (SEQ ID NO: 5162) |
| HIF-1α-2622t2 21 nt Targ: | 5'-CAGTAGGAATTATTTAGCATG-3' | (SEQ ID NO: 5163) |
| HIF-1α-2623t2 21 nt Targ: | 5'-AGTAGGAATTATTTAGCATGT-3' | (SEQ ID NO: 5164) |
| HIF-1α-2624t2 21 nt Targ: | 5'-GTAGGAATTATTTAGCATGTA-3' | (SEQ ID NO: 5165) |

TABLE 6

Selected Human Anti-HIF-1α "Blunt/Fray" DsiRNAs (HIF-1α Variant 1)

```
                              A-3' (SEQ ID NO: 1228)
                              C
5'-GUGAAGACAUCGCGGGGACCGAUUC
3'-CACUUCUGUAGCGCCCCUGGCUAAG
                           U
                           G-5' (SEQ ID NO: 27)
```

HIF-1α-403 Target: 5'-GTGAAGACATCGCGGGGACCGATTCAC-3' (SEQ ID NO: 783)

```
                              A-3' (SEQ ID NO: 1229)
                              C
5'-AAGUUCUGAACGUCGAAAAGAAAAG
3'-UUCAAGACUUGCAGCUUUUCUUUUC
                           A
                           G-5' (SEQ ID NO: 33)
```

HIF-1α-469 Target: 5'-AAGTTCTGAACGTCGAAAAGAAAAGTC-3' (SEQ ID NO: 789)

```
                             C-3' (SEQ ID NO: 1230)
                             C
5'-UCUGAAGUUUUUAUGAGCUUGCUC
3'-AGACUUCAAAAAAUACUCGAACGAG
                           U
                           A-5' (SEQ ID NO: 39)
```

HIF-1α-530 Target: 5'-TCTGAAGTTTTTATGAGCTTGCTCAT-3' (SEQ ID NO: 795)

```
                             C-3' (SEQ ID NO: 1231)
                             A
5'-AAGUUUUUAUGAGCUUGCUCAUCA
3'-UUCAAAAAAUACUCGAACGAGUAGU
                           C
                           A-5' (SEQ ID NO: 41)
```

HIF-1α-534 Target: 5'-AAGTTTTTTATGAGCTTGCTCATCAGT-3' (SEQ ID NO: 797)

```
                             C-3' (SEQ ID NO: 1232)
                             C
5'-GAUGAAUUGCUUUUAUUUGAAAGCC
3'-CUACUUAACGAAAAUAAACUUUCGG
                           A
                           A-5' (SEQ ID NO: 55)
```

HIF-1α-691 Target: 5'-GATGAATTGCTTTTATTTGAAAGCCTT-3' (SEQ ID NO: 811)

```
                              A-3' (SEQ ID NO: 1233)
                              C
5'-AAGCCUUGGAUGGUUUUGUUAUGGU
3'-UUCGGAACCUACCAAAACAAUACCA
                           A
                           G-5' (SEQ ID NO: 57)
```

HIF-1α-711 Target: 5'-AAGCCTTGGATGGTTTTGTTATGGTTC-3' (SEQ ID NO: 813)

```
                              A-3' (SEQ ID NO: 1234)
                              C
5'-GCCUUGGAUGGUUUUGUUAUGGUUC
3'-CGGAACCUACCAAAACAAUACCAAG
                           A
                           G-5' (SEQ ID NO: 58)
```

HIF-1α-713 Target: 5'-GCCTTGGATGGTTTTGTTATGGTTCTC-3' (SEQ ID NO: 814)

```
                              A-3' (SEQ ID NO: 1235)
                              C
5'-CUUGGAUGGUUUUGUUAUGGUUCUC
3'-GAACCUACCAAAACAAUACCAAGAG
                           U
                           G-5' (SEQ ID NO: 59)
```

HIF-1α-715 Target: 5'-CTTGGATGGTTTTGTTATGGTTCTCAC-3' (SEQ ID NO: 815)

TABLE 6-continued

Selected Human Anti-HIF-1α "Blunt/Fray" DsiRNAs (HIF-1α Variant 1)

```
                           A-3' (SEQ ID NO: 1236)
                           C
5'-UGGAUGGUUUUGUUAUGGUUCUCAC
3'-ACCUACCAAAACAAUACCAAGAGUG
                           U
                           C-5' (SEQ ID NO: 60)
```

HIF-1α-717 Target: 5'-TGGATGGTTTTGTTATGGTTCTCACAG-3' (SEQ ID NO: 816)

```
                           C-3' (SEQ ID NO: 1237)
                           A
5'-UGAUUUACAUUUCUGAUAAUGUGAA
3'-ACUAAAUGUAAAGACUAUUACACUU
                           G
                           U-5' (SEQ ID NO: 61)
```

HIF-1α-756 Target: 5'-TGATTTACATTTCTGATAATGTGAACA-3' (SEQ ID NO: 817)

```
                           A-3' (SEQ ID NO: 1238)
                           C
5'-GUGUUUGAUUUUACUCAUCCAUGUG
3'-CACAAACUAAAAUGAGUAGGUACAC
                           U
                           G-5' (SEQ ID NO: 64)
```

HIF-1α-824 Target: 5'-GTGTTTGATTTTACTCATCCATGTGAC-3' (SEQ ID NO: 820)

```
                           C-3' (SEQ ID NO: 1239)
                           C
5'-ACAGUAACCAACCUCAGUGUGGGUA
3'-UGUCAUUGGUUGGAGUCACACCCAU
                           A
                           U-5' (SEQ ID NO: 88)
```

HIF-1α-1041 Target: 5'-ACAGTAACCAACCTCAGTGTGGGTATA-3' (SEQ ID NO: 844)

```
                           C-3' (SEQ ID NO: 1240)
                           A
5'-GGUGCUGAUUUGUGAACCCAUUCCU
3'-CCACGACUAAACACUUGGGUAAGGA
                           G
                           U-5' (SEQ ID NO: 97)
```

HIF-1α-1090 Target: 5'-GGTGCTGATTTGTGAACCCATTCCTCA-3' (SEQ ID NO: 853)

```
                           C-3' (SEQ ID NO: 1241)
                           C
5'-UAUUAUCAUGCUUUGGACUCUGAUC
3'-AUAAUAGUACGAAACCUGAGACUAG
                           U
                           A-5' (SEQ ID NO: 118)
```

HIF-1α-1262 Target: 5'-TATTATCATGCTTTGGACTCTGATCAT-3' (SEQ ID NO: 874)

```
                           A-3' (SEQ ID NO: 1242)
                           A
5'-CAUGCUUUGGACUCUGAUCAUCUGA
3'-GUACGAAACCUGAGACUAGUAGACU
                           G
                           G-5' (SEQ ID NO: 120)
```

HIF-1α-1268 Target: 5'-CATGCTTTGGACTCTGATCATCTGACC-3' (SEQ ID NO: 876)

```
                           C-3' (SEQ ID NO: 1243)
                           C
5'-GCUUUGGACUCUGAUCAUCUGACCA
3'-CGAAACCUGAGACUAGUAGACUGGU
                           U
                           U-5' (SEQ ID NO: 121)
```

HIF-1α-1271 Target: 5'-GCTTTGGACTCTGATCATCTGACCAAA-3' (SEQ ID NO: 877)

TABLE 6-continued

Selected Human Anti-HIF-1α "Blunt/Fray" DsiRNAs (HIF-1α Variant 1)

```
                          C-3' (SEQ ID NO: 1244)
                          A
5'-UACAGGAUGCUUGCCAAAAGAGGUG
3'-AUGUCCUACGAACGGUUUUCUCCAC
                                C
                                U-5' (SEQ ID NO: 145)
```

HIF-1α-1343 Target: 5'-TACAGGATGCTTGCCAAAAGAGGTGGA-3' (SEQ ID NO: 901)

```
                          C-3' (SEQ ID NO: 1245)
                          A
5'-GGAUAUGUCUGGGUUGAAACUCAAG
3'-CCUAUACAGACCCAACUUUGAGUUC
                                G
                                U-5' (SEQ ID NO: 157)
```

HIF-1α-1367 Target: 5'-GGATATGTCTGGGTTGAAACTCAAGCA-3' (SEQ ID NO: 913)

```
                            A-3' (SEQ ID NO: 1246)
                            C
5'-AUAUGUCUGGGUUGAAACUCAAGCA
3'-UAUACAGACCCAAUUUGAGUUCGU
                               U
                               G-5' (SEQ ID NO: 158)
```

HIF-1α-1369 Target: 5'-ATATGTCTGGGTTGAAACTCAAGCAAC-3' (SEQ ID NO: 914)

```
                          C-3' (SEQ ID NO: 1247)
                          C
5'-GGGUUGAAACUCAAGCAACUGUCAU
3'-CCCAACUUUGAGUUCGUUGACAGUA
                                U
                                A-5' (SEQ ID NO: 162)
```

HIF-1α-1377 Target: 5'-GGGTTGAAACTCAAGCAACTGTCATAT-3' (SEQ ID NO: 918)

```
                           C-3' (SEQ ID NO: 1248)
                           C
5'-GUUGAAACUCAAGCAACUGUCAUAU
3'-CAACUUUGAGUUCGUUGACAGUAUA
                                U
                                A-5' (SEQ ID NO: 163)
```

HIF-1α-1379 Target: 5'-GTTGAAACTCAAGCAACTGTCATATAT-3' (SEQ ID NO: 919)

```
                            A-3' (SEQ ID NO: 1249)
                            C
5'-AGCACGACUUGAUUUUCUCCCUUCA
3'-UCGUGCUGAACUAAAAGAGGGAAGU
                                U
                                G-5' (SEQ ID NO: 175)
```

HIF-1α-1470 Target: 5'-AGCACGACTTGATTTTCTCCCTTCAAC-3' (SEQ ID NO: 931)

```
                             A-3' (SEQ ID NO: 1250)
                             C
5'-ACUUGAUUUUCUCCCUUCAACAAAC
3'-UGAACUAAAAGAGGGAAGUUGUUUG
                                U
                                C-5' (SEQ ID NO: 178)
```

HIF-1α-1476 Target: 5'-ACTTGATTTTCTCCCTTCAACAAACAG-3' (SEQ ID NO: 934)

```
                           C-3' (SEQ ID NO: 1251)
                           C
5'-UUGAUUUUCUCCCUUCAACAAACAG
3'-AACUAAAAGAGGGAAGUUGUUUGUC
                                U
                                U-5' (SEQ ID NO: 179)
```

HIF-1α-1478 Target: 5'-TTGATTTTCTCCCTTCAACAAACAGAA-3' (SEQ ID NO: 935)

TABLE 6-continued

Selected Human Anti-HIF-1α "Blunt/Fray" DsiRNAs (HIF-1α Variant 1)

```
                          A-3'  (SEQ ID NO: 1252)
                          C
5'-UUUUCUCCCUUCAACAAACAGAAUG
3'-AAAAGAGGGAAGUUGUUUGUCUUAC
                          A
                          C-5'  (SEQ ID NO: 181)
```

HIF-1α-1482 Target: 5'-TTTTCTCCCTTCAACAAACAGAATGTG-3' (SEQ ID NO: 937)

```
                          A-3'  (SEQ ID NO: 1253)
                          C
5'-CACAAUCAUAUCUUUAGAUUUUGGC
3'-GUGUUAGUAUAGAAAUCUAAAACCG
                          U
                          C-5'  (SEQ ID NO: 185)
```

HIF-1α-1648 Target: 5'-CACAATCATATCTTTAGATTTTGGCAG-3' (SEQ ID NO: 941)

```
                          C-3'  (SEQ ID NO: 1254)
                          C
5'-AAGAAGUUGCAUUAAAAUUAGAACC
3'-UUCUUCAACGUAAUUUUAAUCUUGG
                          U
                          U-5'  (SEQ ID NO: 194)
```

HIF-1α-1845 Target: 5'-AAGAAGTTGCATTAAAATTAGAACCAA-3' (SEQ ID NO: 950)

```
                          A-3'  (SEQ ID NO: 1255)
                          C
5'-GGAAGCACUAGACAAAGUUACCUG
3'-CCUUCGUGAUCUGUUUCAAGUGGAC
                          U
                          C-5'  (SEQ ID NO: 197)
```

HIF-1α-1940 Target: 5'-GGAAGCACTAGACAAAGTTCACCTGAG-3' (SEQ ID NO: 953)

```
                          C-3'  (SEQ ID NO: 1256)
                          C
5'-GCACUAGACAAAGUUCACCUGAGCC
3'-CGUGAUCUGUUUCAAGUGGACUCGG
                          A
                          U-5'  (SEQ ID NO: 199)
```

HIF-1α-1944 Target: 5'-GCACTAGACAAAGTTCACCTGAGCCTA-3' (SEQ ID NO: 955)

```
                          C-3'  (SEQ ID NO: 1257)
                          C
5'-ACUAGACAAAGUUCACCUGAGCCUA
3'-UGAUCUGUUUCAAGUGGACUCGGAU
                          U
                          A-5'  (SEQ ID NO: 200)
```

HIF-1α-1946 Target: 5'-ACTAGACAAAGTTCACCTGAGCCTAAT-3' (SEQ ID NO: 956)

```
                          C-3'  (SEQ ID NO: 1258)
                          A
5'-UGGUAGAAAAACUUUUUGCUGAAGA
3'-ACCAUCUUUUUGAAAAACGACUUCU
                          G
                          U-5'  (SEQ ID NO: 203)
```

HIF-1α-2034 Target: 5'-TGGTAGAAAAACTTTTTGCTGAAGACA-3' (SEQ ID NO: 959)

```
                          C-3'  (SEQ ID NO: 1259)
                          A
5'-AGCAAAAGACAAUUAUUUUAAUACC
3'-UCGUUUUCUGUUAAUAAAAUUAUGG
                          G
                          A-5'  (SEQ ID NO: 220)
```

HIF-1α-2730 Target: 5'-AGCAAAAGACAATTATTTTAATACCCT-3' (SEQ ID NO: 976)

TABLE 6-continued

Selected Human Anti-HIF-1α "Blunt/Fray" DsiRNAs (HIF-1α Variant 1)

```
                        C-3' (SEQ ID NO: 1260)
                        A
5'-UGGAUUACCACAGCUGACCAGUUAU
3'-ACCUAAUGGUGUCGACUGGUCAAUA
                        C
                        U-5' (SEQ ID NO: 223)
```

HIF-1α-2800 Target: 5'-TGGATTACCACAGCTGACCAGTTATGA-3' (SEQ ID NO: 979)

```
                        C-3' (SEQ ID NO: 1261)
                        C
5'-AGCUUUGGAUCAAGUUAACUGAGCU
3'-UCGAAACCUAGUUCAAUUGACUCGA
                        A
                        A-5' (SEQ ID NO: 249)
```

HIF-1α-2890 Target: 5'-AGCTTTGGATCAAGTTAACTGAGCTTT-3' (SEQ ID NO: 1005)

```
                        A-3' (SEQ ID NO: 1262)
                        A
5'-UUCAUUCCUUUUUUUGGACACUGGU
3'-AAGUAAGGAAAAAAACCUGUGACCA
                        C
                        C-5' (SEQ ID NO: 255)
```

HIF-1α-2925 Target: 5'-TTCATTCCTTTTTTTGGACACTGGTGG-3' (SEQ ID NO: 1011)

```
                        A-3' (SEQ ID NO: 1263)
                        C
5'-UUUUUUUGGACACUGGUGGCUCAUU
3'-AAAAAAACCUGUGACCACCGAGUAA
                        U
                        G-5' (SEQ ID NO: 256)
```

HIF-1α-2933 Target: 5'-TTTTTTTGGACACTGGTGGCTCATTAC-3' (SEQ ID NO: 1012)

```
                        A-3' (SEQ ID NO: 1264)
                        C
5'-AAGCAGUCUAUUUAUAUUUUCUACA
3'-UUCGUCAGAUAAAUAUAAAAGAUGU
                        A
                        G-5' (SEQ ID NO: 258)
```

HIF-1α-2963 Target: 5'-AAGCAGTCTATTTATATTTTCTACATC-3' (SEQ ID NO: 1014)

```
                        C-3' (SEQ ID NO: 1265)
                        C
5'-GCAGUCUAUUUAUAUUUUCUACAUC
3'-CGUCAGAUAAAUAUAAAAGAUGUAG
                        A
                        U-5' (SEQ ID NO: 259)
```

HIF-1α-2965 Target: 5'-GCAGTCTATTTATATTTTCTACATCTA-3' (SEQ ID NO: 1015)

```
                        C-3' (SEQ ID NO: 1266)
                        C
5'-CUAUUUAUAUUUUCUACAUCUAAUU
3'-GAUAAAUAUAAAAGAUGUAGAUUAA
                        A
                        A-5' (SEQ ID NO: 260)
```

HIF-1α-2970 Target: 5'-CTATTTATATTTTCTACATCTAATTTT-3' (SEQ ID NO: 1016)

```
                        C-3' (SEQ ID NO: 1267)
                        C
5'-CUUAAUUUACAUUAAUGCUCUUUUU
3'-GAAUUAAAUGUAAUUACGAGAAAAA
                        A
                        U-5' (SEQ ID NO: 271)
```

HIF-1α-3055 Target: 5'-CTTAATTTACATTAATGCTCTTTTTTA-3' (SEQ ID NO: 1027)

TABLE 6-continued

Selected Human Anti-HIF-1α "Blunt/Fray" DsiRNAs (HIF-1α Variant 1)

```
                      A-3' (SEQ ID NO: 1268)
                      C
5'-UCUUUAAUGCUGGAUCACAGACAGC
3'-AGAAAUUACGACCUAGUGUCUGUCG
                      A
                      G-5' (SEQ ID NO: 277)
```

HIF-1α-3088 Target: 5'-TCTTTAATGCTGGATCACAGACAGCTC-3' (SEQ ID NO: 1033)

```
                      C-3' (SEQ ID NO: 1269)
                      C
5'-AGCUCAUUUCUCAGUUUUUGGUA
3'-UCGAGUAAAAGAGUCAAAAACCAU
                      A
                      A-5' (SEQ ID NO: 279)
```

HIF-1α-3110 Target: 5'-AGCTCATTTTCTCAGTTTTTGGTATT-3' (SEQ ID NO: 1035)

```
                      C-3' (SEQ ID NO: 1270)
                      C
5'-CCUUUUUUUCACAUUUUACAUAAA
3'-GGAAAAAAAGUGUAAAAUGUAUUU
                      A
                      U-5' (SEQ ID NO: 294)
```

HIF-1α-3310 Target: 5'-CCTTTTTTTCACATTTTACATAAATA-3' (SEQ ID NO: 1050)

```
                      C-3' (SEQ ID NO: 1271)
                      C
5'-GCCACAAUUGCACAAUAUAUUUUCU
3'-CGGUGUUAACGUGUUAUAUAAAAGA
                      A
                      U-5' (SEQ ID NO: 298)
```

HIF-1α-3364 Target: 5'-GCCACAATTGCACAATATATTTTCTTA-3' (SEQ ID NO: 1054)

```
                      C-3' (SEQ ID NO: 1272)
                      C
5'-CACAAUUGCACAAUAUAUUUUCUUA
3'-GUGUUAACGUGUUAUAUAAAAGAAU
                      U
                      U-5' (SEQ ID NO: 299)
```

HIF-1α-3366 Target: 5'-CACAATTGCACAATATATTTTCTTAAA-3' (SEQ ID NO: 1055)

```
                      C-3' (SEQ ID NO: 1273)
                      A
5'-CACAAUAUAUUUUCUUAAAAAAUAC
3'-GUGUUAUAUAAAAGAAUUUUUUAUG
                      G
                      U-5' (SEQ ID NO: 301)
```

HIF-1α-3374 Target: 5'-CACAATATATTTTCTTAAAAAATACCA-3' (SEQ ID NO: 1057)

```
                      C-3' (SEQ ID NO: 1274)
                      C
5'-UAUAAAACUAGUUUUUAAGAAGAAA
3'-AUAUUUUGAUCAAAAAUUCUUCUUU
                      A
                      A-5' (SEQ ID NO: 305)
```

HIF-1α-3430 Target: 5'-TATAAAACTAGTTTTTAAGAAGAAATT-3' (SEQ ID NO: 1061)

```
                      C-3' (SEQ ID NO: 1275)
                      C
5'-GAAGAAAUUUUUUUUGGCCUAUGAA
3'-CUUCUUUAAAAAAAACCGGAUACUU
                      U
                      A-5' (SEQ ID NO: 307)
```

HIF-1α-3448 Target: 5'-GAAGAAATTTTTTTTGGCCTATGAAAT-3' (SEQ ID NO: 1063)

TABLE 6-continued

Selected Human Anti-HIF-1α "Blunt/Fray" DsiRNAs (HIF-1α Variant 1)

```
                          A-3' (SEQ ID NO: 1276)
                          C
5'-AGAAAUUUUUUUGGCCUAUGAAAU
3'-UCUUUAAAAAAACCGGAUACUUUA
                         A
                          C-5' (SEQ ID NO: 308)
```

HIF-1α-3450 Target: 5'-AGAAATTTTTTTGGCCTATGAAATTG-3' (SEQ ID NO: 1064)

```
                          A-3' (SEQ ID NO: 1277)
                          C
5'-UAUGUGGCAUUUAUUUGGAUAAAAU
3'-AUACACCGUAAAUAAACCUAUUUUA
                         A
                          G-5' (SEQ ID NO: 317)
```

HIF-1α-3598 Target: 5'-TATGTGGCATTTATTTGGATAAAATTC-3' (SEQ ID NO: 1073)

```
                          C-3' (SEQ ID NO: 1278)
                          C
5'-AUAAAAUUCUCAAUUCAGAGAAAUC
3'-UAUUUUAAGAGUUAAGUCUCUUUAG
                         U
                          A-5' (SEQ ID NO: 327)
```

HIF-1α-3616 Target: 5'-ATAAAATTCTCAATTCAGAGAAATCAT-3' (SEQ ID NO: 1083)

```
                          A-3' (SEQ ID NO: 1279)
                          C
5'-AUGUUUCUAUAGUCACUUUGCCAGC
3'-UACAAAGAUAUCAGUGAAACGGUCG
                         A
                          G-5' (SEQ ID NO: 329)
```

HIF-1α-3646 Target: 5'-ATGTTTCTATAGTCACTTTGCCAGCTC-3' (SEQ ID NO: 1085)

```
                          A-3' (SEQ ID NO: 1280)
                          C
5'-CUCAAAAGAAAACAAUACCCUAUGU
3'-GAGUUUUCUUUUGUUAUGGGAUACA
                         U
                          C-5' (SEQ ID NO: 331)
```

HIF-1α-3670 Target: 5'-CTCAAAAGAAAACAATACCCTATGTAG-3' (SEQ ID NO: 1087)

```
                          A-3' (SEQ ID NO: 1281)
                          C
5'-UGUUCUGCCUACCCUGUUGGUAUAA
3'-ACAAGACGGAUGGGACAACCAUAUU
                         U
                          C-5' (SEQ ID NO: 332)
```

HIF-1α-3743 Target: 5'-TGTTCTGCCTACCCTGTTGGTATAAAG-3' (SEQ ID NO: 1088)

```
                          C-3' (SEQ ID NO: 1282)
                          C
5'-CAAGAAAAAAAAAUCAUGCAUUCU
3'-GUUCUUUUUUUUUAGUACGUAAGA
                         A
                          U-5' (SEQ ID NO: 339)
```

HIF-1α-3791 Target: 5'-CAAGAAAAAAAAATCATGCATTCTTA-3' (SEQ ID NO: 1095)

```
                          A-3' (SEQ ID NO: 1283)
                          C
5'-GAUUUAUGCACUUUGUCGCUAUUA
3'-CUAAAAUACGUGAAACAGCGAUAAU
                         U
                          G-5' (SEQ ID NO: 341)
```

HIF-1α-3861 Target: 5'-GATTTTATGCACTTTGTCGCTATTAAC-3' (SEQ ID NO: 1097)

TABLE 6-continued

Selected Human Anti-HIF-1α "Blunt/Fray" DsiRNAs (HIF-1α Variant 1)

```
                        C-3' (SEQ ID NO: 1284)
                        C
5'-UUUUAUGCACUUUGUCGCUAUUAAC
3'-AAAUACGUGAAACAGCGAUAAUUG
                         U
                         A-5' (SEQ ID NO: 342)
```

HIF-1α-3863 Target: 5'-TTTTATGCACTTTGTCGCTATTAACAT-3' (SEQ ID NO: 1098)

```
                        C-3' (SEQ ID NO: 1285)
                        A
5'-CUAUUAACAUCCUUUUUUCAUGUA
3'-GAUAAUUGUAGGAAAAAAGUACAU
                         C
                         U-5' (SEQ ID NO: 350)
```

HIF-1α-3880 Target: 5'-CTATTAACATCCTTTTTTCATGTAGA-3' (SEQ ID NO: 1106)

```
                        C-3' (SEQ ID NO: 1286)
                        C
5'-GUAAUUUUAGAAGCAUUAUUUUAGG
3'-CAUUAAAAUCUUCGUAAUAAAAUCC
                         U
                         U-5' (SEQ ID NO: 353)
```

HIF-1α-3920 Target: 5'-GTAATTTTAGAAGCATTATTTTAGGAA-3' (SEQ ID NO: 1109)

```
                        C-3' (SEQ ID NO: 1287)
                        C
5'-AAUUUUAGAAGCAUUAUUUUAGGAA
3'-UUAAAAUCUUCGUAAUAAAAUCCUU
                         A
                         U-5' (SEQ ID NO: 354)
```

HIF-1α-3922 Target: 5'-AATTTTAGAAGCATTATTTTAGGAATA-3' (SEQ ID NO: 1110)

```
                        C-3' (SEQ ID NO: 1288)
                        C
5'-UUUUAGAAGCAUUAUUUUAGGAAUA
3'-AAAAUCUUCGUAAUAAAAUCCUUAU
                         A
                         U-5' (SEQ ID NO: 355)
```

HIF-1α-3924 Target: 5'-TTTTAGAAGCATTATTTTAGGAATATA-3' (SEQ ID NO: 1111)

```
                        A-3' (SEQ ID NO: 1289)
                        C
5'-AGUAAAUAUCUUGUUUUUCUAUGU
3'-UCAUUUAUAGAACAAAAAGUAACA
                         U
                         G-5' (SEQ ID NO: 359)
```

HIF-1α-3961 Target: 5'-AGTAAATATCTTGTTTTTCTATGTAC-3' (SEQ ID NO: 1115)

```
                        C-3' (SEQ ID NO: 1290)
                        C
5'-CAUUCCUUUUGCUCUUUGUGGUUGG
3'-GUAAGGAAAACGAGAAACACCAACC
                         U
                         A-5' (SEQ ID NO: 364)
```

HIF-1α-4003 Target: 5'-CATTCCTTTTGCTCTTTGTGGTTGGAT-3' (SEQ ID NO: 1120)

```
                        A-3' (SEQ ID NO: 1291)
                        C
5'-AUUCCUUUUGCUCUUUGUGGUUGGA
3'-UAAGGAAAACGAGAAACACCAACCU
                         A
                         G-5' (SEQ ID NO: 365)
```

HIF-1α-4004 Target: 5'-ATTCCTTTTGCTCTTTGTGGTTGGATC-3' (SEQ ID NO: 1121)

TABLE 6-continued

Selected Human Anti-HIF-1α "Blunt/Fray" DsiRNAs (HIF-1α Variant 1)

```
                              C-3' (SEQ ID NO: 1292)
                              A
5'-UUCCUUUUGCUCUUUGUGGUUGGAU
3'-AAGGAAAACGAGAAACACCAACCUA
                              G
                              A-5' (SEQ ID NO: 366)
```

HIF-1α-4005 Target: 5'-TTCCTTTTGCTCTTTGTGGTTGGATCT-3' (SEQ ID NO: 1122)

```
                               C-3' (SEQ ID NO: 1293)
                               C
5'-UUCCUUUUGCUCUUUGUGGUUGGAUC
3'-AGGAAAACGAGAAACACCAACCUAG
                               A
                               U-5' (SEQ ID NO: 367)
```

HIF-1α-4006 Target: 5'-TCCTTTTGCTCTTTGTGGTTGGATCTA-3' (SEQ ID NO: 1123)

```
                               C-3' (SEQ ID NO: 1294)
                               C
5'-CCUUUUGCUCUUUGUGGUUGGAUCU
3'-GGAAAACGAGAAACACCAACCUAGA
                               U
                               U-5' (SEQ ID NO: 368)
```

HIF-1α-4007 Target: 5'-CCTTTTGCTCTTTGTGGTTGGATCTAA-3' (SEQ ID NO: 1124)

```
                               A-3' (SEQ ID NO: 1295)
                               C
5'-CUUUUGCUCUUUGUGGUUGGAUCUA
3'-GAAAACGAGAAACACCAACCUAGAU
                               U
                               G-5' (SEQ ID NO: 369)
```

HIF-1α-4008 Target: 5'-CTTTTGCTCTTTGTGGTTGGATCTAAC-3' (SEQ ID NO: 1125)

```
                               C-3' (SEQ ID NO: 1296)
                               A
5'-UUUUGCUCUUUGUGGUUGGAUCUAA
3'-AAAACGAGAAACACCAACCUAGAUU
                               G
                               U-5' (SEQ ID NO: 370)
```

HIF-1α-4009 Target: 5'-TTTTGCTCTTTGTGGTTGGATCTAACA-3' (SEQ ID NO: 1126)

```
                               A-3' (SEQ ID NO: 1297)
                               C
5'-UUUGCUCUUUGUGGUUGGAUCUAAC
3'-AAACGAGAAACACCAACCUAGAUUG
                               U
                               G-5' (SEQ ID NO: 371)
```

HIF-1α-4010 Target: 5'-TTTGCTCTTTGTGGTTGGATCTAACAC-3' (SEQ ID NO: 1127)

```
                               C-3' (SEQ ID NO: 1298)
                               C
5'-GCAGAAACCUACUGCAGGGUGAAGA
3'-CGUCUUUGGAUGACGUCCCACUUCU
                               U
                               A-5' (SEQ ID NO: 232)
```

HIF-1α-2856 Target: 5'-GCAGAAACCTACTGCAGGGTGAAGAAT-3' (SEQ ID NO: 988)

```
                               C-3' (SEQ ID NO: 1299)
                               A
5'-CAAAUAUUGAAAUUCCUUUAGAUAG
3'-GUUUAUAACUUUAAGGAAAUCUAUC
                               G
                               U-5' (SEQ ID NO: 102)
```

HIF-1α-1122 Target: 5'-CAAATATTGAAATTCCTTTAGATAGCA-3' (SEQ ID NO: 858)

TABLE 6-continued

Selected Human Anti-HIF-1α "Blunt/Fray" DsiRNAs (HIF-1α Variant 1)

```
                        C-3' (SEQ ID NO: 1300)
                        C
5'-AGAAACCUACAGCAGGGUGAAGAAU
3'-UCUUUGGAUGACGUCCCACUUCUUA
                           A
                           U-5' (SEQ ID NO: 233)
```

HIF-1α-2958 Target: 5'-AGAAACCTACTGCAGGGTGAAGAATTA-3' (SEQ ID NO: 989)

```
                        C-3' (SEQ ID NO: 1301)
                        A
5'-ACCUACAGCAGGGUGAAGAAUUACU
3'-UGGAUGACGUCCCACUUCUUAAUGA
                           G
                           U-5' (SEQ ID NO: 235)
```

HIF-1α-2862 Target: 5'-ACCTACTGCAGGGTGAAGAATTACTCA-3' (SEQ ID NO: 991)

```
                        C-3' (SEQ ID NO: 1302)
                        C
5'-CCUUUUUUUCACAUUUUACAUAAA
3'-GGAAAAAAAGUGUAAAAUGUAUUU
                           A
                           U-5' (SEQ ID NO: 294)
```

HIF-1α-3310 Target: 5'-CCTTTTTTTTCACATTTTACATAAATA-3' (SEQ ID NO: 1050)

```
                        A-3' (SEQ ID NO: 1303)
                        A
5'-ACUCAAGCAACUGUCAUAUAUAACA
3'-UGAGUUCGUUGACAGUAUAUAUUGU
                           G
                           G-5' (SEQ ID NO: 166)
```

HIF-1α-1385 Target: 5'-ACTCAAGCAACTGTCATATATAACACC-3' (SEQ ID NO: 922)

```
                        C-3' (SEQ ID NO: 1304)
                        C
5'-AGCUUUGGAUCAAGUUAACUGAGCU
3'-UCGAAACCUAGUUCAAUUGACUCGA
                           A
                           A-5' (SEQ ID NO: 249)
```

HIF-1α-2890 Target: 5'-AGCTTTGGATCAAGTTAACTGAGCTTT-3' (SEQ ID NO: 1005)

```
                        C-3' (SEQ ID NO: 1305)
                        A
5'-AGCGAAGCUUUUUUCUCAGAAUGAA
3'-UCGCUUCGAAAAAAGAGUCUUACUU
                           C
                           A-5' (SEQ ID NO: 79)
```

HIF-1α-921 Target: 5'-AGCGAAGCTTTTTTCTCAGAATGAAGT-3' (SEQ ID NO: 835)

```
                        C-3' (SEQ ID NO: 1306)
                        C
5'-UGCACUUUGUGGUUGGAUCUAACAC
3'-ACGUGAAACACCAACCUAGAUUGUG
                           A
                           U-5' (SEQ ID NO: 372)
```

HIF-1α-4012 Target: 5'-TGCTCTTTGTGGTTGGATCTAACACTA-3' (SEQ ID NO: 1128)

```
                        A-3' (SEQ ID NO: 1307)
                        C
5'-AAGCAUUAUUUUAGGAAUAUAUAGU
3'-UUCGUAAUAAAAUCCUUAUAUAUCA
                           A
                           C-5' (SEQ ID NO: 358)
```

HIF-1α-3930 Target: 5'-AAGCATTATTTTAGGAATATATAGTTG-3' (SEQ ID NO: 1114)

TABLE 6-continued

Selected Human Anti-HIF-1α "Blunt/Fray" DsiRNAs (HIF-1α Variant 1)

```
                          C-3' (SEQ ID NO: 1308)
                          C
5'-GAUUACCACAGCUGACCAGUUAUGA
3'-CUAAUGGUGUCGACUGGUCAAUACU
                          A
                          A-5' (SEQ ID NO: 224)
```

HIF-1α-2902 Target: 5'-GATTACCACAGCTGACCAGTTATGATT-3' (SEQ ID NO: 980)

```
                          C-3' (SEQ ID NO: 1309)
                          C
5'-UGAAACUCAAGCAACUGUCAUAUAU
3'-ACUUUGAGUUCGUUGACAGUAUAUA
                          U
                          U-5' (SEQ ID NO: 164)
```

HIF-1α-1381 Target: 5'-TGAAACTCAAGCAACTGTCATATATAA-3' (SEQ ID NO: 920)

```
                          C-3' (SEQ ID NO: 1310)
                          C
5'-AGUGGAUUAVAVAHVUGACCAGUU
3'-UCACCUAAUGGUGUCGACUGGUCAA
                          U
                          A-5' (SEQ ID NO: 222)
```

HIF-1α-2798 Target: 5'-AGTGGATTACCACAGCTGACCAGTTAT-3' (SEQ ID NO: 978)

```
                          A-3' (SEQ ID NO: 1311)
                          C
5'-AAGCAGUCUAUUUAUAUUUCUACA
3'-UUCGUCAGAUAAAUAUAAAAGAUCU
                          A
                          G-5' (SEQ ID NO: 258)
```

HIF-1α-2963 Target: 5'-AAGCAGTCTATTTATATTTTCTACATC-3' (SEQ ID NO: 1014)

```
                          C-3' (SEQ ID NO: 1312)
                          C
5'-UUGAUUUUCUCCCUUCAACAAACAG
3'-AACUAAAAGAGGGAAGUUGUUUGUC
                          U
                          U-5' (SEQ ID NO: 179)
```

HIF-1α-1478 Target: 5'-TTGATTTTCTCCCTTCAACAAACAGAA-3' (SEQ ID NO: 935)

```
                          C-3' (SEQ ID NO: 1313)
                          C
5'-AAUUACACAGAGCUUUGGAUCAAGU
3'-UUAAUGAGUCUCGAAACCUAGUUCA
                          A
                          U-5' (SEQ ID NO: 244)
```

HIF-1α-2880 Target: 5'-AATTACTCAGAGCTTTGGATCAAGTTA-3' (SEQ ID NO: 1000)

```
                          C-3' (SEQ ID NO: 1314)
                          C
5'-UUGAGUAAUUUUAGAAGCAUUAUUU
3'-AACUCAUUAAAAUCUUCGUAAUAAA
                          A
                          U-5' (SEQ ID NO: 351)
```

HIF-1α-3916 Target: 5'-TTGAGTAATTTTAGAAGCATTATTTA-3' (SEQ ID NO: 1107)

```
                          C-3' (SEQ ID NO: 1315)
                          C
5'-UCUAAUUUUAGAAGCCUGGCUACAA
3'-AGAUUAAAAUCUUCGGACCGAUGUU
                          A
                          U-5' (SEQ ID NO: 262)
```

HIF-1α-2988 Target: 5'-TCTAATTTTAGAAGCCTGGCTACAATA-3' (SEQ ID NO: 1018)

TABLE 6-continued

Selected Human Anti-HIF-1α "Blunt/Fray" DsiRNAs (HIF-1α Variant 1)

```
                              A-3' (SEQ ID NO: 1316)
                              A
5'-UUAUGCACUUUGUCGCUAUUAACAU
3'-AAUACGUGAAACAGCGAUAAUUGUA
                             G
                             G-5' (SEQ ID NO: 343)
```

HIF-1α-3865 Target: 5'-TTATGCACTTTGTCGCTATTAACATCC-3' (SEQ ID NO: 1099)

```
                            C-3' (SEQ ID NO: 1317)
                            C
5'-GGCAGCAGAAACCUACUGCAGGGUG
3'-CCGUCGUCUUUGGAUGACGUCCCAC
                           U
                           U-5' (SEQ ID NO: 230)
```

HIF-1α-2852 Target: 5'-GGCAGCAGAAACCTACTGCAGGGTGAA-3' (SEQ ID NO: 986)

```
                           C-3' (SEQ ID NO: 1318)
                           C
5'-GAAGAAUUACCUCAGAGCUUUGGAUC
3'-CUUCUUAAUGAGUCUCGAAACCUAG
                          U
                          U-5' (SEQ ID NO: 242)
```

HIF-1α-2876 Target: 5'-GAAGAATTACTCAGAGCTTTGGATCAA-3' (SEQ ID NO: 998)

```
                           A-3' (SEQ ID NO: 1319)
                           C
5'-GUGAAGAAUUACUCAGAGCUUUGGA
3'-CACUUCUUAAUGAGUCUCGAAACCU
                          A
                          G-5' (SEQ ID NO: 241)
```

HIF-1α-2874 Target: 5'-GTGAAGAATTACTCAGAGCTTTGGATC-3' (SEQ ID NO: 997)

```
                           A-3' (SEQ ID NO: 1320)
                           C
5'-UUACUCAGAGCUUUGGAUCAAGUUA
3'-AAUGAGUCUCGAAACCUAGUUCAAU
                          U
                          G-5' (SEQ ID NO: 245)
```

HIF-1α-2882 Target: 5'-TTACTCAGAGCTTTGGATCAAGTTAAC-3' (SEQ ID NO: 1001)

TABLE 7

Selected Human Anti-HIF-1α "Blunt/Blunt" DsiRNAs (HIF-1α Variant 1)

| | | |
|---|---|---|
| | 5'-GUGAAGACAUCGCGGGGACCGAUUCAC-3' | (SEQ ID NO: 1321) |
| | 3'-CACUUCUGUAGCGCCCCUGGCUAAGUG-5' | (SEQ ID NO: 27) |
| HIF-1α-403 Target: | 5'-GTGAAGACATCGCGGGGACCGATTCAC-3' | (SEQ ID NO: 783) |
| | 5'-AAGUUCUGAACGUCGAAAAGAAAAGUC-3' | (SEQ ID NO: 1322) |
| | 3'-UUCAAGACUUGCAGCUUUUCUUUUCAG-5' | (SEQ ID NO: 33) |
| HIF-1α-469 Target: | 5'-AAGTTCTGAACGTCGAAAAGAAAAGTC-3' | (SEQ ID NO: 789) |
| | 5'-UCUGAAGUUUUUAUGAGCUUGCUCAU-3' | (SEQ ID NO: 1323) |
| | 3'-AGACUUCAAAAAAUACUCGAACGAGUA-5' | (SEQ ID NO: 39) |
| HIF-1α-530 Target: | 5'-TCTGAAGTTTTTATGAGCTTGCTCAT-3' | (SEQ ID NO: 795) |
| | 5'-AAGUUUUUAUGAGCUUGCUCAUCAGU-3' | (SEQ ID NO: 1324) |
| | 3'-UUCAAAAAAUACUCGAACGAGUAGUCA-5' | (SEQ ID NO: 41) |
| HIF-1α-534 Target: | 5'-AAGTTTTTATGAGCTTGCTCATCAGT-3' | (SEQ ID NO: 797) |
| | 5'-GAUGAAUUGCUUUUAUUUGAAAGCCUU-3' | (SEQ ID NO: 1325) |
| | 3'-CUACUUAACGAAAAUAAACUUUCGGAA-5' | (SEQ ID NO: 55) |

TABLE 7-continued

Selected Human Anti-HIF-1α "Blunt/Blunt" DsiRNAs (HIF-1α Variant 1)

| | | |
|---|---|---|
| HIF-1α-691 Target: | 5'-GATGAATTGCTTTTATTTGAAAGCCTT-3' | (SEQ ID NO: 811) |
| | 5'-AAGCCUUGGAUGGUUUUGUUAUGGUUC-3' | (SEQ ID NO: 1326) |
| | 3'-UUCGGAACCUACCAAAACAAUACCAAG-5' | (SEQ ID NO: 57) |
| HIF-1α-711 Target: | 5'-AAGCCTTGGATGGTTTTGTTATGGTTC-3' | (SEQ ID NO: 813) |
| | 5'-GCCUUGGAUGGUUUUGUUAUGGUUCUC-3' | (SEQ ID NO: 1327) |
| | 3'-CGGAACCUACCAAAACAAUACCAAGAG-5' | (SEQ ID NO: 58) |
| HIF-1α-713 Target: | 5'-GCCTTGGATGGTTTTGTTATGGTTCTC-3' | (SEQ ID NO: 814) |
| | 5'-CUUGGAUGGUUUUGUUAUGGUUCUCAC-3' | (SEQ ID NO: 1328) |
| | 3'-GAACCUACCAAAACAAUACCAAGAGUG-5' | (SEQ ID NO: 59) |
| HIF-1α-715 Target: | 5'-CTTGGATGGTTTTGTTATGGTTCTCAC-3' | (SEQ ID NO: 815) |
| | 5'-UGGAUGGUUUUGUUAUGGUUCUCACAG-3' | (SEQ ID NO: 1329) |
| | 3'-ACCUACCAAAACAAUACCAAGAGUGUC-5' | (SEQ ID NO: 60) |
| HIF-1α-717 Target: | 5'-TGGATGGTTTTGTTATGGTTCTCACAG-3' | (SEQ ID NO: 816) |
| | 5'-UGAUUUACAUUUCUGAUAAUGUGAACA-3' | (SEQ ID NO: 1330) |
| | 3'-ACUAAAUGUAAAGACUAUUACACUUGU-5' | (SEQ ID NO: 61) |
| HIF-1α-756 Target: | 5'-TGATTTACATTTCTGATAATGTGAACA-3' | (SEQ ID NO: 817) |
| | 5'-GUGUUUGAUUUUACUCAUCCAUGUGAC-3' | (SEQ ID NO: 1331) |
| | 3'-CACAAACUAAAAUGAGUAGGUACACUG-5' | (SEQ ID NO: 64) |
| HIF-1α-824 Target: | 5'-GTGTTTGATTTTACTCATCCATGTGAC-3' | (SEQ ID NO: 820) |
| | 5'-ACAGUAACCAACCUCAGUGUGGGUAUA-3' | (SEQ ID NO: 1332) |
| | 3'-UGUCAUUGGUUGGAGUCACACCCAUAU-5' | (SEQ ID NO: 88) |
| HIF-1α-1041 Target: | 5'-ACAGTAACCAACCTCAGTGTGGGTATA-3' | (SEQ ID NO: 844) |
| | 5'-GGUGCUGAUUUGUGAACCCAUUCCUCA-3' | (SEQ ID NO: 1333) |
| | 3'-CCACGACUAAACACUUGGGUAAGGAGU-5' | (SEQ ID NO: 97) |
| HIF-1α-1090 Target: | 5'-GGTGCTGATTTGTGAACCCATTCCTCA-3' | (SEQ ID NO: 853) |
| | 5'-UAUUAUCAUGCUUUGGACUCUGAUCAU-3' | (SEQ ID NO: 1334) |
| | 3'-AUAAUAGUACGAAACCUGAGACUAGUA-5' | (SEQ ID NO: 118) |
| HIF-1α-1262 Target: | 5'-TATTATCATGCTTTGGACTCTGATCAT-3' | (SEQ ID NO: 874) |
| | 5'-CAUGCUUUGGACUCUGAUCAUCUGACC-3' | (SEQ ID NO: 1335) |
| | 3'-GUACGAAACCUGAGACUAGUAGACUGG-5' | (SEQ ID NO: 120) |
| HIF-1α-1268 Target: | 5'-CATGCTTTGGACTCTGATCATCTGACC-3' | (SEQ ID NO: 876) |
| | 5'-GCUUUGGACUCUGAUCAUCUGACCAAA-3' | (SEQ ID NO: 1336) |
| | 3'-CGAAACCUGAGACUAGUAGACUGGUUU-5' | (SEQ ID NO: 121) |
| HIF-1α-1271 Target: | 5'-GCTTTGGACTCTGATCATCTGACCAAA-3' | (SEQ ID NO: 877) |
| | 5'-UACAGGAUGCUUGCCAAAAGAGGUGGA-3' | (SEQ ID NO: 1337) |
| | 3'-AUGUCCUACGAACGGUUUUCUCCACCU-5' | (SEQ ID NO: 145) |
| HIF-1α-1343 Target: | 5'-TACAGGATGCTTGCCAAAAGAGGTGGA-3' | (SEQ ID NO: 901) |
| | 5'-GGAUAUGUCUGGGUUGAAACUCAAGCA-3' | (SEQ ID NO: 1338) |
| | 3'-CCUAUACAGACCCAACUUUGAGUUCGU-5' | (SEQ ID NO: 157) |
| HIF-1α-1367 Target: | 5'-GGATATGTCTGGGTTGAAACTCAAGCA-3' | (SEQ ID NO: 913) |
| | 5'-AUAUGUCUGGGUUGAAACUCAAGCAAC-3' | (SEQ ID NO: 1339) |
| | 3'-UAUACAGACCCAACUUUGAGUUCGUUG-5' | (SEQ ID NO: 158) |
| HIF-1α-1369 Target: | 5'-ATATGTCTGGGTTGAAACTCAAGCAAC-3' | (SEQ ID NO: 914) |
| | 5'-GGGUUGAAACUCAAGCAACUGUCAUAU-3' | (SEQ ID NO: 1340) |
| | 3'-CCCAACUUUGAGUUCGUUGACAGUAUA-5' | (SEQ ID NO: 162) |

TABLE 7-continued

Selected Human Anti-HIF-1α "Blunt/Blunt" DsiRNAs (HIF-1α Variant 1)

```
HIF-1α-1377 Target: 5'-GGGTTGAAACTCAAGCAACTGTCATAT-3'   (SEQ ID NO: 918)

5'-GUUGAAACUCAAGCAACUGUCAUAUAU-3'  (SEQ ID NO: 1341)
                    3'-CAACUUUGAGUUCGUUGACAGUAUAUA-5'  (SEQ ID NO: 163)

HIF-1α-1379 Target: 5'-GTTGAAACTCAAGCAACTGTCATATAT-3'   (SEQ ID NO: 919)

5'-AGCACGACUUGAUUUUCUCCCUUCAAC-3'  (SEQ ID NO: 1342)
                    3'-UCGUGCUGAACUAAAAGAGGGAAGUUG-5'  (SEQ ID NO: 175)

HIF-1α-1470 Target: 5'-AGCACGACTTGATTTTCTCCCTTCAAC-3'   (SEQ ID NO: 931)

5'-ACUUGAUUUUCUCCCUUCAACAAACAG-3'  (SEQ ID NO: 1343)
                    3'-UGAACUAAAAGAGGGAAGUUGUUUGUC-5'  (SEQ ID NO: 178)

HIF-1α-1476 Target: 5'-ACTTGATTTTCTCCCTTCAACAAACAG-3'   (SEQ ID NO: 934)

5'-UUGAUUUUCUCCCUUCAACAAACAGAA-3'  (SEQ ID NO: 1344)
                    3'-AACUAAAAGAGGGAAGUUGUUUGUCUU-5'  (SEQ ID NO: 179)

HIF-1α-1478 Target: 5'-TTGATTTTCTCCCTTCAACAAACAGAA-3'   (SEQ ID NO: 935)

5'-UUUUCUCCCUUCAACAAACAGAAUGUG-3'  (SEQ ID NO: 1345)
                    3'-AAAAGAGGGAAGUUGUUUGUCUUACAC-5'  (SEQ ID NO: 181)

HIF-1α-1482 Target: 5'-TTTTCTCCCTTCAACAAACAGAATGTG-3'   (SEQ ID NO: 937)

5'-CACAAUCAUAUCUUUAGAUUUUGGCAG-3'  (SEQ ID NO: 1346)
                    3'-GUGUUAGUAUAGAAAUCUAAAACCGUC-5'  (SEQ ID NO: 185)

HIF-1α-1648 Target: 5'-CACAATCATATCTTTAGATTTTGGCAG-3'   (SEQ ID NO: 941)

5'-AAGAAGUUGCAUUAAAAUUAGAACCAA-3'  (SEQ ID NO: 1347)
                    3'-UUCUUCAACGUAAUUUUAAUCUUGGUU-5'  (SEQ ID NO: 194)

HIF-1α-1845 Target: 5'-AAGAAGTTGCATTAAAATTAGAACCAA-3'   (SEQ ID NO: 950)

5'-GGAAGCACUAGACAAAGUUCACCUGAG-3'  (SEQ ID NO: 1348)
                    3'-CCUUCGUGAUCUGUUUCAAGUGGACUC-5'  (SEQ ID NO: 197)

HIF-1α-1940 Target: 5'-GGAAGCACTAGACAAAGTTCACCTGAG-3'   (SEQ ID NO: 953)

5'-GCACUAGACAAAGUUCACCUGAGCCUA-3'  (SEQ ID NO: 1349)
                    3'-CGUGAUCUGUUUCAAGUGGACUCGGAU-5'  (SEQ ID NO: 199)

HIF-1α-1944 Target: 5'-GCACTAGACAAAGTTCACCTGAGCCTA-3'   (SEQ ID NO: 955)

5'-ACUAGACAAAGUUCACCUGAGCCUAAU-3'  (SEQ ID NO: 1350)
                    3'-UGAUCUGUUUCAAGUGGACUCGGAUUA-5'  (SEQ ID NO: 200)

HIF-1α-1946 Target: 5'-ACTAGACAAAGTTCACCTGAGCCTAAT-3'   (SEQ ID NO: 956)

5'-UGGUAGAAAAACUUUUUGCUGAAGACA-3'  (SEQ ID NO: 1351)
                    3'-ACCAUCUUUUUGAAAAACGACUUCUGU-5'  (SEQ ID NO: 203)

HIF-1α-2034 Target: 5'-TGGTAGAAAAACTTTTTGCTGAAGACA-3'   (SEQ ID NO: 959)

5'-AGCAAAAGACAAUUAUUUUAAUACCCU-3'  (SEQ ID NO: 1352)
                    3'-UCGUUUUCUGUUAAUAAAAUUAUGGGA-5'  (SEQ ID NO: 220)

HIF-1α-2730 Target: 5'-AGCAAAAGACAATTATTTTAATACCCT-3'   (SEQ ID NO: 976)

5'-UGGAUUACCACAGCUGACCAGUUAUGA-3'  (SEQ ID NO: 1353)
                    3'-ACCUAAUGGUGUCGACUGGUCAAUACU-5'  (SEQ ID NO: 223)

HIF-1α-2800 Target: 5'-TGGATTACCACAGCTGACCAGTTATGA-3'   (SEQ ID NO: 979)

5'-AGCUUUGGAUCAAGUUAACUGAGCUUU-3'  (SEQ ID NO: 1354)
                    3'-UCGAAACCUAGUUCAAUUGACUCGAAA-5'  (SEQ ID NO: 249)

HIF-1α-2890 Target: 5'-AGCTTTGGATCAAGTTAACTGAGCTTT-3'   (SEQ ID NO: 1005)

5'-UUCAUUCCUUUUUUUGGACACUGGUGG-3'  (SEQ ID NO: 1355)
                    3'-AAGUAAGGAAAAAAACCUGUGACCACC-5'  (SEQ ID NO: 255)
```

TABLE 7-continued

Selected Human Anti-HIF-1α "Blunt/Blunt" DsiRNAs (HIF-1α Variant 1)

| | | |
|---|---|---|
| HIF-1α-2925 Target: | 5'-TTCATTCCTTTTTTGGACACTGGTGG-3' | (SEQ ID NO: 1011) |
| | 5'-UUUUUUUGGACACUGGUGGCUCAUUAC-3' | (SEQ ID NO: 1356) |
| | 3'-AAAAAAACCUGUGACCACCGAGUAAUG-5' | (SEQ ID NO: 256) |
| HIF-1α-2933 Target: | 5'-TTTTTTTGGACACTGGTGGCTCATTAC-3' | (SEQ ID NO: 1012) |
| | 5'-AAGCAGUCUAUUUAUAUUUUCUACAUC-3' | (SEQ ID NO: 1357) |
| | 3'-UUCGUCAGAUAAAUAUAAAAGAUGUAG-5' | (SEQ ID NO: 258) |
| HIF-1α-2963 Target: | 5'-AAGCAGTCTATTTATATTTTCTACATC-3' | (SEQ ID NO: 1014) |
| | 5'-GCAGUCUAUUUAUAUUUUCUACAUCUA-3' | (SEQ ID NO: 1358) |
| | 3'-CGUCAGAUAAAUAUAAAAGAUGUAGAU-5' | (SEQ ID NO: 259) |
| HIF-1α-2965 Target: | 5'-GCAGTCTATTTATATTTTCTACATCTA-3' | (SEQ ID NO: 1015) |
| | 5'-CUAUUUAUAUUUUCUACAUCUAAUUUU-3' | (SEQ ID NO: 1359) |
| | 3'-GAUAAAUAUAAAAGAUGUAGAUUAAAA-5' | (SEQ ID NO: 260) |
| HIF-1α-2970 Target: | 5'-CTATTTATATTTTCTACATCTAATTTT-3' | (SEQ ID NO: 1016) |
| | 5'-CUUAAUUUACAUUAAUGCUCUUUUUUA-3' | (SEQ ID NO: 1360) |
| | 3'-GAAUUAAAUGUAAUUACGAGAAAAAAU-5' | (SEQ ID NO: 271) |
| HIF-1α-3055 Target: | 5'-CTTAATTTACATTAATGCTCTTTTTTA-3' | (SEQ ID NO: 1027) |
| | 5'-UCUUUAAUGCUGGAUCACAGACAGCUC-3' | (SEQ ID NO: 1361) |
| | 3'-AGAAAUUACGACCUAGUGUCUGUCGAG-5' | (SEQ ID NO: 277) |
| HIF-1α-3088 Target: | 5'-TCTTTAATGCTGGATCACAGACAGCTC-3' | (SEQ ID NO: 1033) |
| | 5'-AGCUCAUUUUCUCAGUUUUUUGGUAUU-3' | (SEQ ID NO: 1362) |
| | 3'-UCGAGUAAAAGAGUCAAAAAACCAUAA-5' | (SEQ ID NO: 279) |
| HIF-1α-3110 Target: | 5'-AGCTCATTTTCTCAGTTTTTTGGTATT-3' | (SEQ ID NO: 1035) |
| | 5'-CCUUUUUUUUCACAUUUUACAUAAAUA-3' | (SEQ ID NO: 1363) |
| | 3'-GGAAAAAAAAGUGUAAAAUGUAUUUAU-5' | (SEQ ID NO: 294) |
| HIF-1α-3310 Target: | 5'-CCTTTTTTTTCACATTTTACATAAATA-3' | (SEQ ID NO: 1050) |
| | 5'-GCCACAAUUGCACAAUAUAUUUUCUUA-3' | (SEQ ID NO: 1364) |
| | 3'-CGGUGUUAACGUGUUAUAUAAAAGAAU-5' | (SEQ ID NO: 298) |
| HIF-1α-3364 Target: | 5'-GCCACAATTGCACAATATATTTTCTTA-3' | (SEQ ID NO: 1054) |
| | 5'-CACAAUUGCACAAUAUAUUUUCUUAAA-3' | (SEQ ID NO: 1365) |
| | 3'-GUGUUAACGUGUUAUAUAAAAGAAUUU-5' | (SEQ ID NO: 299) |
| HIF-1α-3366 Target: | 5'-CACAATTGCACAATATATTTTCTTAAA-3' | (SEQ ID NO: 1055) |
| | 5'-CACAAUAUAUUUUCUUAAAAAAUACCA-3' | (SEQ ID NO: 1366) |
| | 3'-GUGUUAUAUAAAAGAAUUUUUUAUGGU-5' | (SEQ ID NO: 301) |
| HIF-1α-3374 Target: | 5'-CACAATATATTTTCTTAAAAAATACCA-3' | (SEQ ID NO: 1057) |
| | 5'-UAUAAAACUAGUUUUUAAGAAGAAAUU-3' | (SEQ ID NO: 1367) |
| | 3'-AUAUUUUGAUCAAAAAUUCUUCUUUAA-5' | (SEQ ID NO: 305) |
| HIF-1α-3430 Target: | 5'-TATAAAACTAGTTTTTAAGAAGAAATT-3' | (SEQ ID NO: 1061) |
| | 5'-GAAGAAAUUUUUUUGGCCUAUGAAAU-3' | (SEQ ID NO: 1368) |
| | 3'-CUUCUUUAAAAAAAACCGGAUACUUUA-5' | (SEQ ID NO: 307) |
| HIF-1α-3448 Target: | 5'-GAAGAAATTTTTTTGGCCTATGAAAT-3' | (SEQ ID NO: 1063) |
| | 5'-AGAAAUUUUUUUGGCCUAUGAAAUUG-3' | (SEQ ID NO: 1369) |
| | 3'-UCUUUAAAAAAAACCGGAUACUUUAAC-5' | (SEQ ID NO: 308) |
| HIF-1α-3450 Target: | 5'-AGAAATTTTTTTGGCCTATGAAATTG-3' | (SEQ ID NO: 1064) |
| | 5'-UAUGUGGCAUUUAUUUGGAUAAAAUUC-3' | (SEQ ID NO: 1370) |
| | 3'-AUACACCGUAAAUAAACCUAUUUUAAG-5' | (SEQ ID NO: 317) |

TABLE 7-continued

Selected Human Anti-HIF-1α "Blunt/Blunt" DsiRNAs (HIF-1α Variant 1)

| | | |
|---|---|---|
| HIF-1α-3598 Target: | 5'-TATGTGGCATTTATTTGGATAAAATTC-3' | (SEQ ID NO: 1073) |
| | 5'-AUAAAAUUCUCAAUUCAGAGAAAUCAU-3' | (SEQ ID NO: 1371) |
| | 3'-UAUUUUAAGAGUUAAGUCUCUUUAGUA-5' | (SEQ ID NO: 327) |
| HIF-1α-3616 Target: | 5'-ATAAAATTCTCAATTCAGAGAAATCAT-3' | (SEQ ID NO: 1083) |
| | 5'-AUGUUUCUAUAGUCACUUUGCCAGCUC-3' | (SEQ ID NO: 1372) |
| | 3'-UACAAAGAUAUCAGUGAAACGGUCGAG-5' | (SEQ ID NO: 329) |
| HIF-1α-3646 Target: | 5'-ATGTTTCTATAGTCACTTTGCCAGCTC-3' | (SEQ ID NO: 1085) |
| | 5'-CUCAAAAGAAAACAAUACCCUAUGUAG-3' | (SEQ ID NO: 1373) |
| | 3'-GAGUUUUCUUUUGUUAUGGGAUACAUC-5' | (SEQ ID NO: 331) |
| HIF-1α-3670 Target: | 5'-CTCAAAAGAAAACAATACCCTATGTAG-3' | (SEQ ID NO: 1087) |
| | 5'-UGUUCUGCCUACCCUGUUGGUAUAAAG-3' | (SEQ ID NO: 1374) |
| | 3'-ACAAGACGGAUGGGACAACCAUAUUUC-5' | (SEQ ID NO: 332) |
| HIF-1α-3743 Target: | 5'-TGTTCTGCCTACCCTGTTGGTATAAAG-3' | (SEQ ID NO: 1088) |
| | 5'-CAAGAAAAAAAAAAUCAUGCAUUCUUA-3' | (SEQ ID NO: 1375) |
| | 3'-GUUCUUUUUUUUUUAGUACGUAAGAAU-5' | (SEQ ID NO: 339) |
| HIF-1α-3791 Target: | 5'-CAAGAAAAAAAAAATCATGCATTCTTA-3' | (SEQ ID NO: 1095) |
| | 5'-GAUUUUAUGCACUUUGUCGCUAUUAAC-3' | (SEQ ID NO: 1376) |
| | 3'-CUAAAAUACGUGAAACAGCGAUAAUUG-5' | (SEQ ID NO: 341) |
| HIF-1α-3861 Target: | 5'-GATTTTATGCACTTTGTCGCTATTAAC-3' | (SEQ ID NO: 1097) |
| | 5'-UUUUAUGCACUUUGUCGCUAUUAACAU-3' | (SEQ ID NO: 1377) |
| | 3'-AAAAUACGUGAAACAGCGAUAAUUGUA-5' | (SEQ ID NO: 342) |
| HIF-1α-3863 Target: | 5'-TTTTATGCACTTTGTCGCTATTAACAT-3' | (SEQ ID NO: 1098) |
| | 5'-CUAUUAACAUCCUUUUUUUCAUGUAGA-3' | (SEQ ID NO: 1378) |
| | 3'-GAUAAUUGUAGGAAAAAAAGUACAUCU-5' | (SEQ ID NO: 350) |
| HIF-1α-3880 Target: | 5'-CTATTAACATCCTTTTTTTCATGTAGA-3' | (SEQ ID NO: 1106) |
| | 5'-GUAAUUUUAGAAGCAUUAUUUUAGGAA-3' | (SEQ ID NO: 1379) |
| | 3'-CAUUAAAAUCUUCGUAAUAAAAUCCUU-5' | (SEQ ID NO: 353) |
| HIF-1α-3920 Target: | 5'-GTAATTTTAGAAGCATTATTTTAGGAA-3' | (SEQ ID NO: 1109) |
| | 5'-AAUUUUAGAAGCAUUAUUUUAGGAAUA-3' | (SEQ ID NO: 1380) |
| | 3'-UUAAAAUCUUCGUAAUAAAAUCCUUAU-5' | (SEQ ID NO: 354) |
| HIF-1α-3922 Target: | 5'-AATTTTAGAAGCATTATTTTAGGAATA-3' | (SEQ ID NO: 1110) |
| | 5'-UUUUAGAAGCAUUAUUUUAGGAAUAUA-3' | (SEQ ID NO: 1381) |
| | 3'-AAAAUCUUCGUAAUAAAAUCCUUAUAU-5' | (SEQ ID NO: 355) |
| HIF-1α-3924 Target: | 5'-TTTTAGAAGCATTATTTTAGGAATATA-3' | (SEQ ID NO: 1111) |
| | 5'-AGUAAAUAUCUUGUUUUUUCUAUGUAC-3' | (SEQ ID NO: 1382) |
| | 3'-UCAUUUAUAGAACAAAAAAGAUACAUG-5' | (SEQ ID NO: 359) |
| HIF-1α-3961 Target: | 5'-AGTAAATATCTTGTTTTTCTATGTAC-3' | (SEQ ID NO: 1115) |
| | 5'-CAUUCCUUUUGCUCUUUGUGGUUGGAU-3' | (SEQ ID NO: 1383) |
| | 3'-GUAAGGAAAACGAGAAACACCAACCUA-5' | (SEQ ID NO: 364) |
| HIF-1α-4003 Target: | 5'-CATTCCTTTTGCTCTTTGTGGTTGGAT-3' | (SEQ ID NO: 1120) |
| | 5'-AUUCCUUUUGCUCUUUGUGGUUGGAUC-3' | (SEQ ID NO: 1384) |
| | 3'-UAAGGAAAACGAGAAACACCAACCUAG-5' | (SEQ ID NO: 365) |
| HIF-1α-4004 Target: | 5'-ATTCCTTTTGCTCTTTGTGGTTGGATC-3' | (SEQ ID NO: 1121) |
| | 5'-UUCCUUUUGCUCUUUGUGGUUGGAUCU-3' | (SEQ ID NO: 1385) |
| | 3'-AAGGAAAACGAGAAACACCAACCUAGA-5' | (SEQ ID NO: 366) |

TABLE 7-continued

Selected Human Anti-HIF-1α "Blunt/Blunt" DsiRNAs (HIF-1α Variant 1)

```
HIF-1α-4005 Target: 5'-TTCCTTTTGCTCTTTGTGGTTGGATCT-3'      (SEQ ID NO: 1122)

5'-UCCUUUUGCUCUUUGUGGUUGGAUCUA-3'     (SEQ ID NO: 1386)
                    3'-AGGAAAACGAGAAACACCAACCUAGAU-5'     (SEQ ID NO: 367)

HIF-1α-4006 Target: 5'-TCCTTTTGCTCTTTGTGGTTGGATCTA-3'     (SEQ ID NO: 1123)

5'-CCUUUUGCUCUUUGUGGUUGGAUCUAA-3'    (SEQ ID NO: 1387)
                    3'-GGAAAACGAGAAACACCAACCUAGAUU-5'    (SEQ ID NO: 368)

HIF-1α-4007 Target: 5'-CCTTTTGCTCTTTGTGGTTGGATCTAA-3'    (SEQ ID NO: 1124)

5'-CUUUUGCUCUUUGUGGUUGGAUCUAAC-3'    (SEQ ID NO: 1388)
                    3'-GAAAACGAGAAACACCAACCUAGAUUG-5'    (SEQ ID NO: 369)

HIF-1α-4008 Target: 5'-CTTTTGCTCTTTGTGGTTGGATCTAAC-3'    (SEQ ID NO: 1125)

5'-UUUUGCUCUUUGUGGUUGGAUCUAACA-3'    (SEQ ID NO: 1389)
                    3'-AAAACGAGAAACACCAACCUAGAUUGU-5'    (SEQ ID NO: 370)

HIF-1α-4009 Target: 5'-TTTTGCTCTTTGTGGTTGGATCTAACA-3'    (SEQ ID NO: 1126)

5'-UUUGCUCUUUGUGGUUGGAUCUAACAC-3'    (SEQ ID NO: 1390)
                    3'-AAACGAGAAACACCAACCUAGAUUGUG-5'    (SEQ ID NO: 371)

HIF-1α-4010 Target: 5'-TTTGCTCTTTGTGGTTGGATCTAACAC-3'    (SEQ ID NO: 1127)

5'-GCAGAAACCUACUGCAGGGUGAAGAAU-3'    (SEQ ID NO: 1391)
                    3'-CGUCUUUGGAUGACGUCCCACUUCUUA-5'    (SEQ ID NO: 232)

HIF-1α-2856 Target: 5'-GCAGAAACCTACTGCAGGGTGAAGAAT-3'    (SEQ ID NO: 988)

5'-CAAAUAUUGAAAUUCCUUUAGAUAGCA-3'    (SEQ ID NO: 1392)
                    3'-GUUUAUAACUUUAAGGAAAUCUAUCGU-5'    (SEQ ID NO: 102)

HIF-1α-1122 Target: 5'-CAAATATTGAAATTCCTTTAGATAGCA-3'    (SEQ ID NO: 858)

5'-AGAAACCUACUGCAGGGUGAAGAAUUA-3'    (SEQ ID NO: 1393)
                    3'-UCUUUGGAUGACGUCCCACUUCUUAAU-5'    (SEQ ID NO: 233)

HIF-1α-2858 Target: 5'-AGAAACCTACTGCAGGGTGAAGAATTA-3'    (SEQ ID NO: 989)

5'-ACCUACUGCAGGGUGAAGAAUUACUCA-3'    (SEQ ID NO: 1394)
                    3'-UGGAUGACGUCCCACUUCUUAAUGAGU-5'    (SEQ ID NO: 235)

HIF-1α-2862 Target: 5'-ACCTACTGCAGGGTGAAGAATTACTCA-3'    (SEQ ID NO: 991)

5'-CCUUUUUUUUCACAUUUUACAUAAAUA-3'    (SEQ ID NO: 1395)
                    3'-GGAAAAAAAAGUGUAAAAUGUAUUUAU-5'    (SEQ ID NO: 294)

HIF-1α-3310 Target: 5'-CCTTTTTTTTCACATTTTACATAAATA-3'    (SEQ ID NO: 1050)

5'-ACUCAAGCAACUGUCAUAUAUAACACC-3'    (SEQ ID NO: 1396)
                    3'-UGAGUUCGUUGACAGUAUAUAUUGUGG-5'    (SEQ ID NO: 166)

HIF-1α-1385 Target: 5'-ACTCAAGCAACTGTCATATATAACACC-3'    (SEQ ID NO: 922)

5'-AGCUUUGGAUCAAGUUAACUGAGCUUU-3'    (SEQ ID NO: 1397)
                    3'-UCGAAACCUAGUUCAAUUGACUCGAAA-5'    (SEQ ID NO: 249)

HIF-1α-2890 Target: 5'-AGCTTTGGATCAAGTTAACTGAGCTTT-3'    (SEQ ID NO: 1005)

5'-AGCGAAGCUUUUUCUCAGAAUGAAGU-3'     (SEQ ID NO: 1398)
                    3'-UCGCUUCGAAAAAGAGUCUUACUUCA-5'     (SEQ ID NO: 79)

HIF-1α-921 Target:  5'-AGCGAAGCTTTTTCTCAGAATGAAGT-3'      (SEQ ID NO: 835)

5'-UGCUCUUUGUGGUUGGAUCUAACACUA-3'    (SEQ ID NO: 1399)
                    3'-ACGAGAAACACCAACCUAGAUUGUGAU-5'    (SEQ ID NO: 372)

HIF-1α-4012 Target: 5'-TGCTCTTTGTGGTTGGATCTAACACTA-3'    (SEQ ID NO: 1128)

5'-AAGCAUUAUUUUAGGAAUAUAUAGUUG-3'    (SEQ ID NO: 1400)
                    3'-UUCGUAAUAAAAUCCUUAUAUAUCAAC-5'    (SEQ ID NO: 358)
```

TABLE 7-continued

Selected Human Anti-HIF-1α "Blunt/Blunt" DsiRNAs (HIF-1α Variant 1)

```
HIF-1α-3930 Target: 5'-AAGCATTATTTTAGGAATATATAGTTG-3'   (SEQ ID NO: 1114)

5'-GAUUACCACAGCUGACCAGUUAUGAUU-3'   (SEQ ID NO: 1401)
                    3'-CUAAUGGUGUCGACUGGUCAAUACUAA-5'   (SEQ ID NO: 224)

HIF-1α-2802 Target: 5'-GATTACCACAGCTGACCAGTTATGATT-3'   (SEQ ID NO: 980)

5'-UGAAACUCAAGCAACUGUCAUAUAUAA-3'   (SEQ ID NO: 1402)
                    3'-ACUUUGAGUUCGUUGACAGUAUAUAUU-5'   (SEQ ID NO: 164)

HIF-1α-1381 Target: 5'-TGAAACTCAAGCAACTGTCATATATAA-3'   (SEQ ID NO: 920)

5'-AGUGGAUUACCACAGCUGACCAGUUAU-3'   (SEQ ID NO: 1403)
                    3'-UCACCUAAUGGUGUCGACUGGUCAAUA-5'   (SEQ ID NO: 222)

HIF-1α-2798 Target: 5'-AGTGGATTACCACAGCTGACCAGTTAT-3'   (SEQ ID NO: 978)

5'-AAGCAGUCUAUUUAUAUUUUCUACAUC-3'   (SEQ ID NO: 1404)
                    3'-UUCGUCAGAUAAAUAUAAAAGAUGUAG-5'   (SEQ ID NO: 258)

HIF-1α-2963 Target: 5'-AAGCAGTCTATTTATATTTTCTACATC-3'   (SEQ ID NO: 1014)

5'-UUGAUUUUCUCCCUUCAACAAACAGAA-3'   (SEQ ID NO: 1405)
                    3'-AACUAAAAGAGGGAAGUUGUUUGUCUU-5'   (SEQ ID NO: 179)

HIF-1α-1478 Target: 5'-TTGATTTTCTCCCTTCAACAAACAGAA-3'   (SEQ ID NO: 935)

5'-AAUUACUCAGAGCUUUGGAUCAAGUUA-3'   (SEQ ID NO: 1406)
                    3'-UUAAUGAGUCUCGAAACCUAGUUCAAU-5'   (SEQ ID NO: 244)

HIF-1α-2880 Target: 5'-AATTACTCAGAGCTTTGGATCAAGTTA-3'   (SEQ ID NO: 1000)

5'-UUGAGUAAUUUUAGAAGCAUUAUUUUA-3'   (SEQ ID NO: 1407)
                    3'-AACUCAUUAAAAUCUUCGUAAUAAAAU-5'   (SEQ ID NO: 351)

HIF-1α-3916 Target: 5'-TTGAGTAATTTTAGAAGCATTATTTTA-3'   (SEQ ID NO: 1107)

5'-UCUAAUUUUAGAAGCCUGGCUACAAUA-3'   (SEQ ID NO: 1408)
                    3'-AGAUUAAAAUCUUCGGACCGAUGUUAU-5'   (SEQ ID NO: 262)

HIF-1α-2988 Target: 5'-TCTAATTTTAGAAGCCTGGCTACAATA-3'   (SEQ ID NO: 1018)

5'-UUAUGCACUUUGUCGCUAUUAACAUCC-3'   (SEQ ID NO: 1409)
                    3'-AAUACGUGAAACAGCGAUAAUUGUAGG-5'   (SEQ ID NO: 343)

HIF-1α-3865 Target: 5'-TTATGCACTTTGTCGCTATTAACATCC-3'   (SEQ ID NO: 1099)

5'-GGCAGCAGAAACCUACUGCAGGGUGAA-3'   (SEQ ID NO: 1410)
                    3'-CCGUCGUCUUUGGAUGACGUCCCACUU-5'   (SEQ ID NO: 230)

HIF-1α-2852 Target: 5'-GGCAGCAGAAACCTACTGCAGGGTGAA-3'   (SEQ ID NO: 986)

5'-GAAGAAUUACUCAGAGCUUUGGAUCAA-3'   (SEQ ID NO: 1411)
                    3'-CUUCUUAAUGAGUCUCGAAACCUAGUU-5'   (SEQ ID NO: 242)

HIF-1α-2876 Target: 5'-GAAGAATTACTCAGAGCTTTGGATCAA-3'   (SEQ ID NO: 998)

5'-GUGAAGAAUUACUCAGAGCUUUGGAUC-3'   (SEQ ID NO: 1412)
                    3'-CACUUCUUAAUGAGUCUCGAAACCUAG-5'   (SEQ ID NO: 241)

HIF-1α-2874 Target: 5'-GTGAAGAATTACTCAGAGCTTTGGATC-3'   (SEQ ID NO: 997)

5'-UUACUCAGAGCUUUGGAUCAAGUUAAC-3'   (SEQ ID NO: 1413)
                    3'-AAUGAGUCUCGAAACCUAGUUCAAUUG-5'   (SEQ ID NO: 245)

HIF-1α-2882 Target: 5'-TTACTCAGAGCTTTGGATCAAGTTAAC-3'   (SEQ ID NO: 1001)
```

Within Tables 2-4 and 6-7 above, underlined residues indicate 2'-O-methyl residues, UPPER CASE indicates ribonucleotides, and lower case denotes deoxyribonucleotides. The DsiRNA agents of Tables 2-4 above are 25/27mer agents possessing a blunt end. The structures and/or modification patterning of the agents of Tables 2-4 and 6-7 above can be readily adapted to the above generic sequence structures, e.g., the 3' overhang of the second strand can be extended or contracted, 2'-O-methylation of the second strand can be expanded towards the 5' end of the second strand, optionally at alternating sites, etc. Such further modifications are optional, as 25/27mer DsiRNAs with such modifications can also be readily designed from the above DsiRNA agents and are also expected to be functional inhibitors of HIF-1α expression. Similarly, the 27mer "blunt/fray" and "blunt/blunt" DsiRNA structures and/or modification patterns of the agents of Tables 6-7 above can also be readily adapted to the above generic sequence structures, e.g., for application of modification patterning of the antisense strand to such structures and/or adaptation of such sequences to the above generic structures.

In certain embodiments, 27mer DsiRNAs possessing independent strand lengths each of 27 nucleotides are designed and synthesized for targeting of the same sites within the HIF-1α transcript as the asymmetric "25/27" structures shown in Tables 2-4 herein. Exemplary "27/27" DsiRNAs are optionally designed with a "blunt/fray" structure as shown for the DsiRNAs of Table 6 above, or with a "blunt/blunt" structure as shown for the DsiRNAs of Tables 7 above.

In certain embodiments, the dsRNA agents of the invention require, e.g., at least 19, at least 20, at least 21, at least 22, at least 23, at least 24, at least 25 or at least 26 residues of the first strand to be complementary to corresponding residues of the second strand. In certain related embodiments, these first strand residues complementary to corresponding residues of the second strand are optionally consecutive residues.

By definition, "sufficiently complementary" (contrasted with, e.g., "100% complementary") allows for one or more mismatches to exist between a dsRNA of the invention and the target RNA or cDNA sequence (e.g., HIF-1α mRNA), provided that the dsRNA possesses complementarity sufficient to trigger the destruction of the target RNA by the RNAi machinery (e.g., the RISC complex) or process. In certain embodiments, a "sufficiently complementary" dsRNA of the invention can harbor one, two, three or even four or more mismatches between the dsRNA sequence and the target RNA or cDNA sequence (e.g., in certain such embodiments, the antisense strand of the dsRNA harbors one, two, three, four, five or even six or more mismatches when aligned with the target RNA or cDNA sequence). Additional consideration of the preferred location of such mismatches within certain dsRNAs of the instant invention is considered in greater detail below.

As used herein "DsiRNAmm" refers to a DisRNA having a "mismatch tolerant region" containing one, two, three or four mismatched base pairs of the duplex formed by the sense and antisense strands of the DsiRNA, where such mismatches are positioned within the DsiRNA at a location(s) lying between (and thus not including) the two terminal base pairs of either end of the DsiRNA. The mismatched base pairs are located within a "mismatch-tolerant region" which is defined herein with respect to the location of the projected Ago2 cut site of the corresponding target nucleic acid. The mismatch tolerant region is located "upstream of" the projected Ago2 cut site of the target strand. "Upstream" in this context will be understood as the 5'-most portion of the DsiRNAmm duplex, where 5' refers to the orientation of the sense strand of the DsiRNA duplex. Therefore, the mismatch tolerant region is upstream of the base on the sense (passenger) strand that corresponds to the projected Ago2 cut site of the target nucleic acid (see FIG. 1); alternatively, when referring to the antisense (guide) strand of the DsiRNAmm, the mismatch tolerant region can also be described as positioned downstream of the base that is complementary to the projected Ago2 cut site of the target nucleic acid, that is, the 3'-most portion of the antisense strand of the DsiRNAmm (where position 1 of the antisense strand is the 5' terminal nucleotide of the antisense strand, see FIG. 1).

In one embodiment, for example with numbering as depicted in FIG. 1, the mismatch tolerant region is positioned between and including base pairs 3-9 when numbered from the nucleotide starting at the 5' end of the sense strand of the duplex. Therefore, a DsiRNAmm of the invention possesses a single mismatched base pair at any one of positions 3, 4, 5, 6, 7, 8 or 9 of the sense strand of a right-hand extended DsiRNA (where position 1 is the 5' terminal nucleotide of the sense strand and position 9 is the nucleotide residue of the sense strand that is immediately 5' of the projected Ago2 cut site of the target HIF-1α RNA sequence corresponding to the sense strand sequence). In certain embodiments, for a DsiRNAmm that possesses a mismatched base pair nucleotide at any of positions 3, 4, 5, 6, 7, 8 or 9 of the sense strand, the corresponding mismatched base pair nucleotide of the antisense strand not only forms a mismatched base pair with the DsiRNAmm sense strand sequence, but also forms a mismatched base pair with a DsiRNAmm target HIF-1α RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target HIF-1α RNA sequence). In alternative embodiments, the mismatch base pair nucleotide of the antisense strand of a DsiRNAmm only form a mismatched base pair with a corresponding nucleotide of the sense strand sequence of the DsiRNAmm, yet base pairs with its corresponding target HIF-1α RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target HIF-1α RNA sequence).

A DsiRNAmm of the invention that possesses a single mismatched base pair within the mismatch-tolerant region (mismatch region) as described above (e.g., a DsiRNAmm harboring a mismatched nucleotide residue at any one of positions 3, 4, 5, 6, 7, 8 or 9 of the sense strand) can further include one, two or even three additional mismatched base pairs. In preferred embodiments, these one, two or three additional mismatched base pairs of the DsiRNAmm occur at position(s) 3, 4, 5, 6, 7, 8 and/or 9 of the sense strand (and at corresponding residues of the antisense strand). In one embodiment where one additional mismatched base pair is present within a DsiRNAmm, the two mismatched base pairs of the sense strand can occur, e.g., at nucleotides of both position 4 and position 6 of the sense strand (with mismatch also occurring at corresponding nucleotide residues of the antisense strand).

In DsiRNAmm agents possessing two mismatched base pairs, mismatches can occur consecutively (e.g., at consecutive positions along the sense strand nucleotide sequence). Alternatively, nucleotides of the sense strand that form mismatched base pairs with the antisense strand sequence can be interspersed by nucleotides that base pair with the antisense strand sequence (e.g., for a DsiRNAmm possessing mismatched nucleotides at positions 3 and 6, but not at positions 4 and 5, the mismatched residues of sense strand positions 3 and 6 are interspersed by two nucleotides that form matched base pairs with corresponding residues of the antisense strand). For example, two residues of the sense strand (located within the mismatch-tolerant region of the sense strand) that form mismatched base pairs with the corresponding antisense strand sequence can occur with zero, one, two, three, four or five matched base pairs located between these mismatched base pairs.

For certain DsiRNAmm agents possessing three mismatched base pairs, mismatches can occur consecutively (e.g., in a triplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 4 and 8, but not at positions 5, 6 and 7, the mismatched residues of sense strand positions 3 and 4 are adjacent to one another, while the mismatched residues of sense strand positions 4 and 8 are interspersed by three nucleotides that form matched base pairs with corresponding residues of the antisense strand). For example, three residues of the sense strand (located within the mismatch-tolerant region of the sense strand) that form mismatched base pairs with the corresponding antisense strand sequence can occur with zero, one, two, three or four matched base pairs located between any two of these mismatched base pairs.

For certain DsiRNAmm agents possessing four mismatched base pairs, mismatches can occur consecutively (e.g., in a quadruplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 5, 7 and 8, but not at positions 4 and 6, the mismatched residues of sense strand positions 7 and 8 are adjacent to one another, while the mismatched residues of sense strand positions 3 and 5 are interspersed by one nucleotide that forms a matched base pair with the corresponding residue of the antisense strand—similarly, the mismatched residues of sense strand positions 5 and 7 are also interspersed by one nucleotide that forms a matched base pair with the corresponding residue of the antisense strand). For example, four residues of the sense strand (located within the mismatch-tolerant region of the sense strand) that form mismatched base pairs with the corresponding antisense strand sequence can occur with zero, one, two or three matched base pairs located between any two of these mismatched base pairs.

In another embodiment, for example with numbering also as depicted in FIG. 1, a DsiRNAmm of the invention comprises a mismatch tolerant region which possesses a single mismatched base pair nucleotide at any one of positions 17, 18, 19, 20, 21, 22 or 23 of the antisense strand of the DsiRNA (where position 1 is the 5' terminal nucleotide of the antisense strand and position 17 is the nucleotide residue of the antisense strand that is immediately 3' (downstream) in the antisense strand of the projected Ago2 cut site of the target HIF-1α RNA sequence sufficiently complementary to the antisense strand sequence). In certain embodiments, for a DsiRNAmm that possesses a mismatched base pair nucleotide at any of positions 17, 18, 19, 20, 21, 22 or 23 of the antisense strand with respect to the sense strand of the DsiR-NAmm, the mismatched base pair nucleotide of the antisense strand not only forms a mismatched base pair with the DsiRNAmm sense strand sequence, but also forms a mismatched base pair with a DsiRNAmm target HIF-1α RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target HIF-1α RNA sequence). In alternative embodiments, the mismatch base pair nucleotide of the antisense strand of a DsiRNAmm only forms a mismatched base pair with a corresponding nucleotide of the sense strand sequence of the DsiRNAmm, yet base pairs with its corresponding target HIF-1α RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target HIF-1α RNA sequence).

A DsiRNAmm of the invention that possesses a single mismatched base pair within the mismatch-tolerant region as described above (e.g., a DsiRNAmm harboring a mismatched nucleotide residue at positions 17, 18, 19, 20, 21, 22 or 23 of the antisense strand) can further include one, two or even three additional mismatched base pairs. In preferred embodiments, these one, two or three additional mismatched base pairs of the DsiRNAmm occur at position(s) 17, 18, 19, 20, 21, 22 and/or 23 of the antisense strand (and at corresponding residues of the sense strand). In one embodiment where one additional mismatched base pair is present within a DsiRNAmm, the two mismatched base pairs of the antisense strand can occur, e.g., at nucleotides of both position 18 and position 20 of the antisense strand (with mismatch also occurring at corresponding nucleotide residues of the sense strand).

In DsiRNAmm agents possessing two mismatched base pairs, mismatches can occur consecutively (e.g., at consecutive positions along the antisense strand nucleotide sequence). Alternatively, nucleotides of the antisense strand that form mismatched base pairs with the sense strand sequence can be interspersed by nucleotides that base pair with the sense strand sequence (e.g., for a DsiRNAmm possessing mismatched nucleotides at positions 17 and 20, but not at positions 18 and 19, the mismatched residues of antisense strand positions 17 and 20 are interspersed by two nucleotides that form matched base pairs with corresponding residues of the sense strand). For example, two residues of the antisense strand (located within the mismatch-tolerant region of the sense strand) that form mismatched base pairs with the corresponding sense strand sequence can occur with zero, one, two, three, four, five, six or seven matched base pairs located between these mismatched base pairs.

For certain DsiRNAmm agents possessing three mismatched base pairs, mismatches can occur consecutively (e.g., in a triplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 17, 18 and 22, but not at positions 19, 20 and 21, the mismatched residues of antisense strand positions 17 and 18 are adjacent to one another, while the mismatched residues of antisense strand positions 18 and 122 are interspersed by three nucleotides that form matched base pairs with corresponding residues of the sense strand). For example, three residues of the antisense strand (located within the mismatch-tolerant region of the antisense strand) that form mismatched base pairs with the corresponding sense strand sequence can occur with zero, one, two, three, four, five or six matched base pairs located between any two of these mismatched base pairs.

For certain DsiRNAmm agents possessing four mismatched base pairs, mismatches can occur consecutively (e.g., in a quadruplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 18, 20, 22 and 23, but not at positions 19 and 21, the mismatched residues of antisense strand positions 22 and 23 are adjacent to one another, while the mismatched residues of antisense strand positions 18 and 20 are interspersed by one nucleotide that forms a matched base pair with the corresponding residue of the sense strand—similarly, the mismatched residues of antisense strand positions 20 and 22 are also interspersed by one nucleotide that forms a matched base pair with the corresponding residue of the sense strand). For example, four residues of the antisense strand (located within the mismatch-tolerant region of the antisense strand) that form mismatched base pairs with the corresponding sense strand sequence can occur with zero, one, two, three, four or five matched base pairs located between any two of these mismatched base pairs.

For reasons of clarity, the location(s) of mismatched nucleotide residues within the above DsiRNAmm agents are numbered in reference to the 5' terminal residue of either sense or antisense strands of the DsiRNAmm. The numbering of positions located within the mismatch-tolerant region (mismatch region) of the antisense strand can shift with variations in the proximity of the 5' terminus of the sense or antisense strand to the projected Ago2 cleavage site. Thus, the location(s) of preferred mismatch sites within either antisense strand or sense strand can also be identified as the permissible proximity of such mismatches to the projected Ago2 cut site. Accordingly, in one preferred embodiment, the position of a mismatch nucleotide of the sense strand of a DsiRNAmm is the nucleotide residue of the sense strand that is located immediately 5' (upstream) of the projected Ago2 cleavage site of the corresponding target HIF-1α RNA sequence. In other preferred embodiments, a mismatch nucleotide of the sense strand of a DsiRNAmm is positioned at the nucleotide residue of the sense strand that is located two nucleotides 5' (upstream) of the projected Ago2 cleavage site, three nucleotides 5' (upstream) of the projected Ago2 cleavage site, four nucleotides 5' (upstream) of the projected Ago2 cleavage site, five nucleotides 5' (upstream) of the projected Ago2 cleavage site, six nucleotides 5' (upstream) of the projected Ago2 cleavage site, seven nucleotides 5' (upstream) of the projected Ago2 cleavage site, eight nucleotides 5' (upstream) of the projected Ago2 cleavage site, or nine nucleotides 5' (upstream) of the projected Ago2 cleavage site.

Exemplary single mismatch-containing 25/27mer DsiRNAs (DsiRNAmm) include the following structures (such mismatch-containing structures may also be incorporated into other exemplary DsiRNA structures shown herein).

```
5'-XX^MXXXXXXXXXXXXXXXXXXXXDD-3'
3'-XXXX_MXXXXXXXXXXXXXXXXXXXXX-5'

5'-XXX^MXXXXXXXXXXXXXXXXXXXXDD-3'
3'-XXXXX_MXXXXXXXXXXXXXXXXXXXX-5'

5'-XXXX^MXXXXXXXXXXXXXXXXXXXDD-3'
3'-XXXXXX_MXXXXXXXXXXXXXXXXXXX-5'

5'-XXXXX^MXXXXXXXXXXXXXXXXXXDD-3'
3'-XXXXXXX_MXXXXXXXXXXXXXXXXXX-5'

5'-XXXXXX^MXXXXXXXXXXXXXXXXXDD-3'
3'-XXXXXXXX_MXXXXXXXXXXXXXXXXX-5'

5'-XXXXXXX^MXXXXXXXXXXXXXXXXDD-3'
3'-XXXXXXXXX_MXXXXXXXXXXXXXXXX-5'

5'-XXXXXXXX^MXXXXXXXXXXXXXXXDD-3'
3'-XXXXXXXXXX_MXXXXXXXXXXXXXXX-5'
``` wherein "X"=RNA, "D"=DNA and "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNAmm agents. For the above mismatch structures, the top strand is the sense strand, and the bottom strand is the antisense strand.

In certain embodiments, a DsiRNA of the invention can contain mismatches that exist in reference to the target HIF-1α RNA sequence yet do not necessarily exist as mismatched base pairs within the two strands of the DsiRNA—thus, a DsiRNA can possess perfect complementarity between first and second strands of a DsiRNA, yet still possess mismatched residues in reference to a target HIF-1α RNA (which, in certain embodiments, may be advantageous in promoting efficacy and/or potency and/or duration of effect). In certain embodiments, where mismatches occur between antisense strand and target HIF-1α RNA sequence, the position of a mismatch is located within the antisense strand at a position (s) that corresponds to a sequence of the sense strand located 5' of the projected Ago2 cut site of the target region—e.g., antisense strand residue(s) positioned within the antisense strand to the 3' of the antisense residue which is complementary to the projected Ago2 cut site of the target sequence.

Exemplary 25/27mer DsiRNAs that harbor a single mismatched residue in reference to target sequences include the following structures.

```
Target RNA Sequence:      5'-. . . AXXXXXXXXXXXXXXXXXXXX . . .-3'
DsiRNAmm Sense Strand:    5'-XXXXXXXXXXXXXXXXXXXXXXXDD-3'
DsiRNAmm Antisense Strand: 3'-EXXXXXXXXXXXXXXXXXXXXXXXXX-5'

Target RNA Sequence:      5'-. . . XAXXXXXXXXXXXXXXXXXXX . . .-3'
DsiRNAmm Sense Strand:    5'-XXXXXXXXXXXXXXXXXXXXXXXDD-3'
DsiRNAmm Antisense Strand: 3'-XEXXXXXXXXXXXXXXXXXXXXXXXX-5'
```

```
                            -continued
Target RNA Sequence:         5'-. . . AXXXXXXXXXXXXXXXXXX . . .-3'
DsiRNAmm Sense Strand:       5'-BXXXXXXXXXXXXXXXXXXXXXXXDD-3'
DsiRNAmm Antisense Strand:   3'-XXEXXXXXXXXXXXXXXXXXXXXXXXX-5'

Target RNA Sequence:         5'-. . . XAXXXXXXXXXXXXXXXXX . . .-3'
DsiRNAmm Sense Strand:       5'-XBXXXXXXXXXXXXXXXXXXXXXXDD-3'
DsiRNAmm Antisense Strand:   3'-XXXEXXXXXXXXXXXXXXXXXXXXXXX-5'

Target RNA Sequence:         5'-. . . XXAXXXXXXXXXXXXXXXX . . .-3'
DsiRNAmm Sense Strand:       5'-XXBXXXXXXXXXXXXXXXXXXXXXDD-3'
DsiRNAmm Antisense Strand:   3'-XXXXEXXXXXXXXXXXXXXXXXXXXXX-5'

Target RNA Sequence:         5'-. . . XXXAXXXXXXXXXXXXXXX . . .-3'
DsiRNAmm Sense Strand:       5'-XXXBXXXXXXXXXXXXXXXXXXXXDD-3'
DsiRNAmm Antisense Strand:   3'-XXXXXEXXXXXXXXXXXXXXXXXXXXX-5'

Target RNA Sequence:         5'-. . . XXXXAXXXXXXXXXXXXXX . . .-3'
DsiRNAmm Sense Strand:       5'-XXXXBXXXXXXXXXXXXXXXXXXXDD-3'
DsiRNAmm Antisense Strand:   3'-XXXXXXEXXXXXXXXXXXXXXXXXXXX-5'

Target RNA Sequence:         5'-. . . XXXXXAXXXXXXXXXXXXX . . .-3'
DsiRNAmm Sense Strand:       5'-XXXXXBXXXXXXXXXXXXXXXXXXDD-3'
DsiRNAmm Antisense Strand:   3'-XXXXXXXEXXXXXXXXXXXXXXXXXXX-5'

Target RNA Sequence:         5'-. . . XXXXXXAXXXXXXXXXXXX . . .-3'
DsiRNAmm Sense Strand:       5'-XXXXXXBXXXXXXXXXXXXXXXXXDD-3'
DsiRNAmm Antisense Strand:   3'-XXXXXXXXEXXXXXXXXXXXXXXXXXX-5'

Target RNA Sequence:         5'-. . . XXXXXXXAXXXXXXXXXXX . . .-3'
DsiRNAmm Sense Strand:       5'-XXXXXXXBXXXXXXXXXXXXXXXXDD-3'
DsiRNAmm Antisense Strand:   3'-XXXXXXXXXEXXXXXXXXXXXXXXXXX-5'

Target RNA Sequence:         5'-. . . XXXXXXXXAXXXXXXXXXX . . .-3'
DsiRNAmm Sense Strand:       5'-XXXXXXXXBXXXXXXXXXXXXXXXDD-3'
DsiRNAmm Antisense Strand:   3'-XXXXXXXXXXEXXXXXXXXXXXXXXXX-5'
``` wherein "X"=RNA, "D"=DNA and "E"=Nucleic acid residues (RNA, DNA or non-natural or modified nucleic acids) that do not base pair (hydrogen bond) with corresponding "A" RNA residues of otherwise complementary (target) strand when strands are annealed, yet optionally do base pair with corresponding "B" residues ("B" residues are also RNA, DNA or non-natural or modified nucleic acids). Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNA agents.

In certain embodiments, the guide strand of a dsRNA of the invention that is sufficiently complementary to a target RNA (e.g., mRNA) along at least 19 nucleotides of the target gene sequence to reduce target gene expression is not perfectly complementary to the at least 19 nucleotide long target gene sequence. Rather, it is appreciated that the guide strand of a dsRNA of the invention that is sufficiently complementary to a target mRNA along at least 19 nucleotides of a target RNA sequence to reduce target gene expression can have one, two, three, or even four or more nucleotides that are mismatched with the 19 nucleotide or longer target strand sequence. Thus, for a 19 nucleotide target RNA sequence, the guide strand of a dsRNA of the invention can be sufficiently complementary to the target RNA sequence to reduce target gene levels while possessing, e.g., only 15/19, 16/19, 17/19 or 18/19 matched nucleotide residues between guide strand and target RNA sequence.

In addition to the above-exemplified structures, dsRNAs of the invention can also possess one, two or three additional residues that form further mismatches with the target HIF-1α RNA sequence. Such mismatches can be consecutive, or can be interspersed by nucleotides that form matched base pairs with the target HIF-1α RNA sequence. Where interspersed by nucleotides that form matched base pairs, mismatched residues can be spaced apart from each other within a single strand at an interval of one, two, three, four, five, six, seven or even eight base paired nucleotides between such mismatch-forming residues.

As for the above-described DsiRNAmm agents, a preferred location within dsRNAs (e.g., DsiRNAs) for antisense strand nucleotides that form mismatched base pairs with target HIF-1α RNA sequence (yet may or may not form mismatches with corresponding sense strand nucleotides) is within the antisense strand region that is located 3' (downstream) of the antisense strand sequence which is complementary to the projected Ago2 cut site of the DsiRNA (e.g., in FIG. 1, the region of the antisense strand which is 3' of the projected Ago2 cut site is preferred for mismatch-forming residues and happens to be located at positions 17-23 of the antisense strand for the 25/27mer agent shown in FIG. 1). Thus, in one embodiment, the position of a mismatch nucleotide (in relation to the target HIF-1α RNA sequence) of the antisense strand of a DsiRNAmm is the nucleotide residue of the antisense strand that is located immediately 3' (downstream) within the antisense strand sequence of the projected Ago2 cleavage site of the corresponding target HIF-1α RNA sequence. In other preferred embodiments, a mismatch nucleotide of the antisense strand of a DsiRNAmm (in relation to the target HIF-1α RNA sequence) is positioned at the nucleotide residue of the antisense strand that is located two nucleotides 3' (downstream) of the corresponding projected Ago2 cleavage site, three nucleotides 3' (downstream) of the corresponding projected Ago2 cleavage site, four nucleotides 3' (downstream) of the corresponding projected Ago2 cleavage site, five nucleotides 3' (downstream) of the corresponding projected Ago2 cleavage site, six nucleotides 3' (downstream) of the projected Ago2 cleavage site, seven nucleotides 3' (downstream) of the projected Ago2 cleavage site, eight nucleotides 3' (downstream) of the projected Ago2 cleavage site, or nine nucleotides 3' (downstream) of the projected Ago2 cleavage site.

In dsRNA agents possessing two mismatch-forming nucleotides of the antisense strand (where mismatch-forming nucleotides are mismatch forming in relation to target HIF-1α RNA sequence), mismatches can occur consecutively (e.g., at consecutive positions along the antisense strand nucleotide sequence). Alternatively, nucleotides of the antisense strand that form mismatched base pairs with the target HIF-1α RNA sequence can be interspersed by nucleotides that base pair with the target HIF-1α RNA sequence (e.g., for a DsiRNA possessing mismatch-forming nucleotides at positions 17 and 20 (starting from the 5' terminus (position 1) of the antisense strand of the 25/27mer agent shown in FIG. 1), but not at positions 18 and 19, the mismatched residues of sense strand positions 17 and 20 are interspersed by two nucleotides that form matched base pairs with corresponding residues of the target HIF-1α RNA sequence). For example, two residues of the antisense strand (located within the mismatch-tolerant region of the antisense strand) that form mismatched base pairs with the corresponding target HIF-1α RNA sequence can occur with zero, one, two, three, four or five matched base pairs (with respect to target HIF-1α RNA sequence) located between these mismatch-forming base pairs.

For certain dsRNAs possessing three mismatch-forming base pairs (mismatch-forming with respect to target HIF-1α RNA sequence), mismatch-forming nucleotides can occur consecutively (e.g., in a triplet along the antisense strand nucleotide sequence). Alternatively, nucleotides of the antisense strand that form mismatched base pairs with the target HIF-1α RNA sequence can be interspersed by nucleotides that form matched base pairs with the target HIF-1α RNA sequence (e.g., for a DsiRNA possessing mismatched nucleotides at positions 17, 18 and 22, but not at positions 19, 20 and 21, the mismatch-forming residues of antisense strand positions 17 and 18 are adjacent to one another, while the mismatch-forming residues of antisense strand positions 18 and 22 are interspersed by three nucleotides that form matched base pairs with corresponding residues of the target HIF-1α RNA). For example, three residues of the antisense strand (located within the mismatch-tolerant region of the antisense strand) that form mismatched base pairs with the corresponding target HIF-1α RNA sequence can occur with zero, one, two, three or four matched base pairs located between any two of these mismatch-forming base pairs.

For certain dsRNAs possessing four mismatch-forming base pairs (mismatch-forming with respect to target HIF-1α RNA sequence), mismatch-forming nucleotides can occur consecutively (e.g., in a quadruplet along the sense strand nucleotide sequence). Alternatively, nucleotides of the antisense strand that form mismatched base pairs with the target HIF-1α RNA sequence can be interspersed by nucleotides that form matched base pairs with the target HIF-1α RNA sequence (e.g., for a DsiRNA possessing mismatch-forming nucleotides at positions 17, 19, 21 and 22, but not at positions 18 and 20, the mismatch-forming residues of antisense strand positions 21 and 22 are adjacent to one another, while the mismatch-forming residues of antisense strand positions 17 and 19 are interspersed by one nucleotide that forms a matched base pair with the corresponding residue of the target HIF-1α RNA sequence—similarly, the mismatch-forming residues of antisense strand positions 19 and 21 are also interspersed by one nucleotide that forms a matched base pair with the corresponding residue of the target HIF-1α RNA sequence). For example, four residues of the antisense strand (located within the mismatch-tolerant region of the antisense strand) that form mismatched base pairs with the corresponding target HIF-1α RNA sequence can occur with zero, one, two or three matched base pairs located between any two of these mismatch-forming base pairs.

The above DsiRNAmm and other dsRNA structures are described in order to exemplify certain structures of DsiRNAmm and dsRNA agents. Design of the above DsiRNAmm and dsRNA structures can be adapted to generate, e.g., DsiRNAmm forms of other DsiRNA structures shown infra. As exemplified above, dsRNAs can also be designed that possess single mismatches (or two, three or four mismatches) between the antisense strand of the dsRNA and a target sequence, yet optionally can retain perfect complementarity between sense and antisense strand sequences of a dsRNA.

It is further noted that the dsRNA agents exemplified infra can also possess insertion/deletion (in/del) structures within their double-stranded and/or target HIF-1α RNA-aligned structures. Accordingly, the dsRNAs of the invention can be designed to possess in/del variations in, e.g., antisense strand sequence as compared to target HIF-1α RNA sequence and/ or antisense strand sequence as compared to sense strand sequence, with preferred location(s) for placement of such in/del nucleotides corresponding to those locations described above for positioning of mismatched and/or mismatch-forming base pairs.

It is also noted that the DsiRNAs of the instant invention can tolerate mismatches within the 3'-terminal region of the sense strand/5'-terminal region of the antisense strand, as this region is modeled to be processed by Dicer and liberated from the guide strand sequence that loads into RISC. Exemplary DsiRNA structures of the invention that harbor such mismatches include the following:

```
Target RNA Sequence:     5'-. . . XXXXXXXXXXXXXXXXXXXXHXXX . . .-3'
DsiRNA Sense Strand:     5'-XXXXXXXXXXXXXXXXXXXXIXDD-3'
DsiRNA Antisense Strand: 3'-XXXXXXXXXXXXXXXXXXXXXXJXXX-5'

Target RNA Sequence:     5'-. . . XXXXXXXXXXXXXXXXXXXXHXX . . .-3'
DsiRNA Sense Strand:     5'-XXXXXXXXXXXXXXXXXXXXIDD-3'
DsiRNA Antisense Strand: 3'-XXXXXXXXXXXXXXXXXXXXXXJXX-5'

Target RNA Sequence:     5'-. . . XXXXXXXXXXXXXXXXXXXXHX . . .-3'
DsiRNA Sense Strand:     5'-XXXXXXXXXXXXXXXXXXXXID-3'
DsiRNA Antisense Strand: 3'-XXXXXXXXXXXXXXXXXXXXXXJX-5'

Target RNA Sequence:     5'-. . . XXXXXXXXXXXXXXXXXXXXH . . .-3'
DsiRNA Sense Strand:     5'-XXXXXXXXXXXXXXXXXXXXDI-3'
DsiRNA Antisense Strand: 3'-XXXXXXXXXXXXXXXXXXXXXXJ-5'
``` wherein "X"=RNA, "D"=DNA and "I" and "J"=Nucleic acid residues (RNA, DNA or non-natural or modified nucleic acids) that do not base pair (hydrogen bond) with one another, yet optionally "J" is complementary to target RNA sequence nucleotide "H". Any of the residues of such agents can optionally be 2'-O-methyl RNA monomers—alternating positioning of 2'-O-methyl RNA monomers that commences from the 3'-terminal residue of the bottom (second) strand, as shown above—or any of the above-described methylation patterns—can also be used in the above DsiRNA agents. The above mismatches can also be combined within the DsiRNAs of the instant invention.

In the below structures, such mismatches are introduced within the asymmetric HIF-1α-1385 DsiRNA (newly-introduced mismatch residues are italicized):

HIF-1α-1385 25/27mer DsiRNA, mismatch position=22 of sense strand (from 5'-terminus)

```
                                        (SEQ ID NO: 2080)
5'-UCAAGCAACUGUCAUAUAUAA^A ACC-3'

(SEQ ID NO: 166)
3'-UGAGUUCGUUGACAGUAUAUAUU_G UGG-5'
```

Optionally, the mismatched "A" residue of position 22 of the sense strand is alternatively "U" or "G".

HIF-1α-1385 25/27mer DsiRNA, mismatch position=23 of sense strand

```
                                        (SEQ ID NO: 2081)
5'-UCAAGCAACUGUCAUAUAUAAC^C cc-3'

(SEQ ID NO: 166)
3'-UGAGUUCGUUGACAGUAUAUAUUG_U GG-5'
```

Optionally, the mismatched "C" residue of position 23 of the sense strand is alternatively "G" or "U".

HIF-1α-1385 25/27mer DsiRNA, mismatch position=24 of sense strand

```
                                        (SEQ ID NO: 2082)
5'-GAAAAAGAUAAUAACUCAGUUCA^a C-3'

(SEQ ID NO: 166)
3'-UGAGUUCGUUGACAGUAUAUAUUGU_G G-5'
```

Optionally, the mismatched "a" residue of position 24 of the sense strand is alternatively "g" or "t".

HIF-1α-1385 25/27mer DsiRNA, mismatch position=25 of sense strand

```
                                        (SEQ ID NO: 2083)
5'-GAAAAAGAUAAUAACUCAGUUCAc^a -3'

(SEQ ID NO: 166)
3'-UGAGUUCGUUGACAGUAUAUAUUGUG_G -5'
```

Optionally, the mismatched "a" residue of position 25 of the sense strand is alternatively "t" or "g".

HIF-1α-1385 25/27mer DsiRNA, mismatch position=1 of antisense strand

```
                                        (SEQ ID NO: 544)
5'-UCAAGCAACUGUCAUAUAUAACAc^c -3'

(SEQ ID NO: 2084)
3'-UGAGUUCGUUGACAGUAUAUAUUGUG_A -5'
```

Optionally, the mismatched "A" residue of position 1 of the antisense strand is alternatively "U" or "C".

HIF-1α-1385 25/27mer DsiRNA, mismatch position=2 of antisense strand

```
                                        (SEQ ID NO: 544)
5'-UCAAGCAACUGUCAUAUAUAACA^c c-3'

(SEQ ID NO: 2085)
3'-UGAGUUCGUUGACAGUAUAUAUUGU_A G-5'
```

Optionally, the mismatched "A" residue of position 2 of the antisense strand is alternatively "C" or "U".

HIF-1α-1385 25/27mer DsiRNA, mismatch position=3 of antisense strand

```
                                        (SEQ ID NO: 544)
5'-UCAAGCAACUGUCAUAUAUAAC^A cc-3'

(SEQ ID NO: 2086)
3'-UGAGUUCGUUGACAGUAUAUAUUG_C GG-5'
```

Optionally, the mismatched "C" residue of position 3 of the antisense strand is alternatively "A" or "G".

HIF-1α-1385 25/27mer DsiRNA, mismatch position=4 of antisense strand

```
                                        (SEQ ID NO: 544)
5'-UCAAGCAACUGUCAUAUAUAA^C Acc-3'

(SEQ ID NO: 2087)
3'-UGAGUUCGUUGACAGUAUAUAUU_A UGG-5'
```

Optionally, the mismatched "A" residue of position 4 of the antisense strand is alternatively "U" or "C".

As noted above, introduction of such mismatches can be performed upon any of the DsiRNAs described herein.

The mismatches of such DsiRNA structures can be combined to produce a DsiRNA possessing, e.g., two, three or even four mismatches within the 3'-terminal four nucleotides of the sense strand/5'-terminal four nucleotides of the antisense strand.

Indeed, in view of the flexibility of sequences which can be incorporated into DsiRNAs at the 3'-terminal residues of the sense strand/5'-terminal residues of the antisense strand, in certain embodiments, the sequence requirements of an asymmetric DsiRNA of the instant invention can be represented as the following (minimalist) structure (shown for an exemplary HIF-1α-1385 DsiRNA sequence):

```
                                        (SEQ ID NO: 2088)
5'-UCAAGCAACUGUCAUAUAUAAXXX[X]_n-3'

(SEQ ID NO: 2089)
3'-UGAGUUCGUUGACAGUAUAUAXXXXX[X]_n-5'
``` where n=1 to 5, 1 to 10, 1 to 20, 1 to 30, 1 to 50, or 1 to 80 or more.

HIF-1α-1385 Target:

5'-ACTCAAGCAACTGTCATATATXXXXXX-3' (SEQ ID NO: 2090)

The HIF-1α target sight may also be a site which is targeted by one or more of several oligonucleotides whose complementary target sites overlap with a stated target site. For example, for an exemplary HIF-1α-2860 DsiRNA, it is noted that certain DsiRNAs targeting overlapping and only slightly offset HIF-1α sequences can exhibit activity levels similar to that of HIF-1α-2860 (specifically, see HIF-1α-2852, HIF-1α-2856, HIF-1α-2858, HIF-1α-2862 and HIF-1α-2864

Figure 3A:
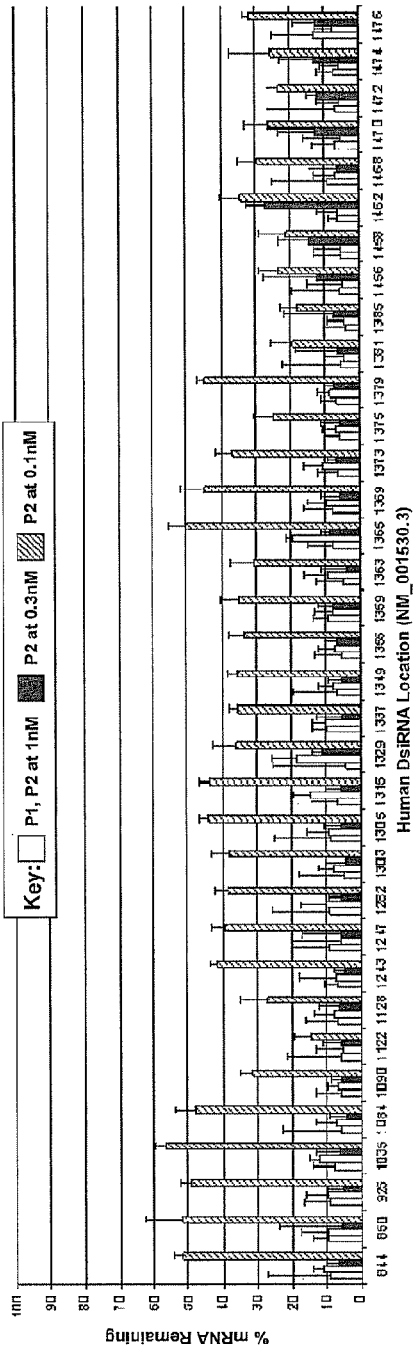
FIGS. 3A to 3F show histograms of human and mouse HIF-1α inhibitory efficacies observed for indicated DsiRNAs. "P1" indicates phase 1 (primary screen), while "P2" indicates phase 2. In phase 1, DsiRNAs were tested at 1 nM in the environment of HeLa cells (human cell assays.
Figure 3A:
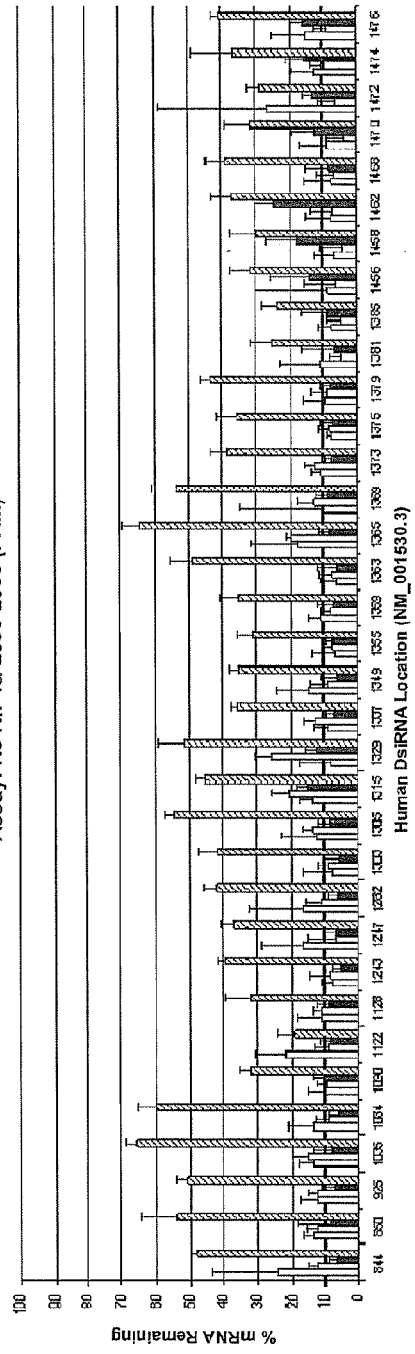
Figure 3B:
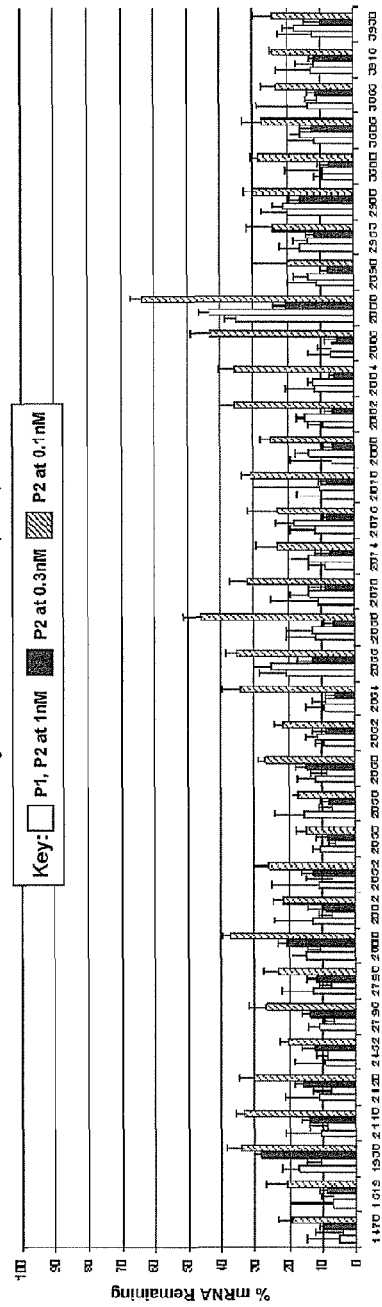
Figure 3B:
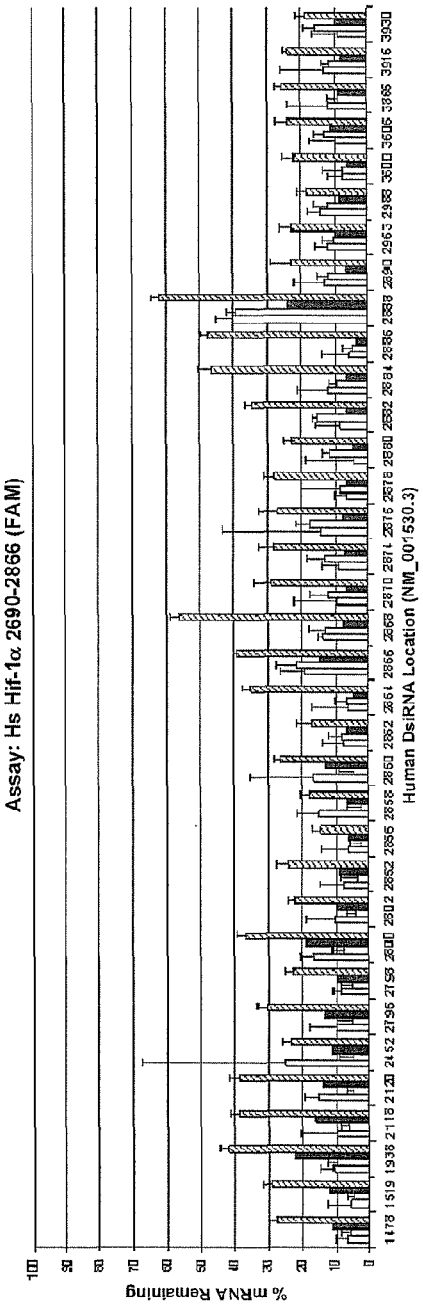

DsiRNAs of FIG. 3B. Thus, in certain embodiments, a designated target sequence region can be effectively targeted by a series of DsiRNAs possessing largely overlapping sequences. (E.g., if considering DsiRNAs surrounding the HIF-1α-2860 site, a more encompassing HIF-1α target sequence might be recited as, e.g., 5'-GGCAGCAGAAAC-CTACTGCAGGGTGAAGAATTACTCAGA-3' (SEQ ID NO: 2091), wherein any given DsiRNA (e.g., a DsiRNA selected from HIF-1α-2852, HIF-1α-2853, HIF-1α-2854, HIF-1α-2855, HIF-1α-2856, HIF-1α-2857, HIF-1α-2858, HIF-1α-2859, HIF-1α-2860, HIF-1α-2861, HIF-1α-2862, HIF-1α-2863 and HIF-1α-2864) only targets a sub-sequence within such a sequence region, yet the entire sequence can be considered a viable target for such a series of DsiRNAs).

Additionally and/or alternatively, mismatches within the 3'-terminal four nucleotides of the sense strand/5'-terminal four nucleotides of the antisense strand can be combined with mismatches positioned at other mismatch-tolerant positions, as described above.

In view of the present identification of the above-described Dicer substrate agents (DsiRNAs) as inhibitors of HIF-1α levels via targeting of specific HIF-1α sequences, it is also recognized that dsRNAs having structures similar to those described herein can also be synthesized which target other sequences within the HIF-1α sequence of NM_001530.3, NM_181054.2 or NM_010431.2, or within variants thereof (e.g., target sequences possessing 80% identity, 90% identity, 95% identity, 96% identity, 97% identity, 98% identity, 99% or more identity to a sequence of NM_001530.3, NM_181054.2 and/or NM_010431.2).

Anti-HIF-1α DsiRNA Design/Synthesis

It has been found empirically that longer dsRNA species of from 25 to 35 nucleotides (DsiRNAs) and especially from 25 to 30 nucleotides give unexpectedly effective results in terms of potency and duration of action, as compared to 19-23mer siRNA agents. Without wishing to be bound by the underlying theory of the dsRNA processing mechanism, it is thought that the longer dsRNA species serve as a substrate for the Dicer enzyme in the cytoplasm of a cell. In addition to cleaving the dsRNA of the invention into shorter segments, Dicer is thought to facilitate the incorporation of a single-stranded cleavage product derived from the cleaved dsRNA into the RISC complex that is responsible for the destruction of the cytoplasmic RNA (e.g., HIF-1α RNA) of or derived from the target gene, HIF-1α (or other gene associated with a HIF-1α-associated disease or disorder). Prior studies (Rossi et al., U.S. Patent Application No. 2007/0265220) have shown that the cleavability of a dsRNA species (specifically, a DsiRNA agent) by Dicer corresponds with increased potency and duration of action of the dsRNA species.

Certain preferred anti-HIF-1α DsiRNA agents were selected from a pre-screened population. Design of DsiRNAs can optionally involve use of predictive scoring algorithms that perform in silico assessments of the projected activity/efficacy of a number of possible DsiRNA agents spanning a region of sequence. Information regarding the design of such scoring algorithms can be found, e.g., in Gong et al. (*BMC Bioinformatics* 2006, 7:516), though a more recent "v3" algorithm represents a theoretically improved algorithm relative to siRNA scoring algorithms previously available in the art. (E.g., the "v3" and "v4" scoring algorithms are machine learning algorithms that are not reliant upon any biases in human sequence. In addition, the "v3" and "v4" algorithms derive from data sets that are many-fold larger than that from which an older "v2" algorithm such as that described in Gong et al. derives).

The first and second oligonucleotides of the DsiRNA agents of the instant invention are not required to be completely complementary. In fact, in one embodiment, the 3'-terminus of the sense strand contains one or more mismatches. In one aspect, two mismatches are incorporated at the 3' terminus of the sense strand. In another embodiment, the DsiRNA of the invention is a double stranded RNA molecule containing two RNA oligonucleotides each of which is 27 nucleotides in length and, when annealed to each other, have blunt ends and a two nucleotide mismatch on the 3'-terminus of the sense strand (the 5'-terminus of the antisense strand). The use of mismatches or decreased thermodynamic stability (specifically at the 3'-sense/5'-antisense position) has been proposed to facilitate or favor entry of the antisense strand into RISC (Schwarz et al., 2003, *Cell* 115: 199-208; Khvorova et al., 2003, *Cell* 115: 209-216), presumably by affecting some rate-limiting unwinding steps that occur with entry of the siRNA into RISC. Thus, terminal base composition has been included in design algorithms for selecting active 21mer siRNA duplexes (Ui-Tei et al., 2004, *Nucleic Acids Res* 32: 936-948; Reynolds et al., 2004, *Nat Biotechnol* 22: 326-330). With Dicer cleavage of the dsRNA of this embodiment, the small end-terminal sequence which contains the mismatches will either be left unpaired with the antisense strand (become part of a 3'-overhang) or be cleaved entirely off the final 21-mer siRNA. These "mismatches", therefore, do not persist as mismatches in the final RNA component of RISC. The finding that base mismatches or destabilization of segments at the 3'-end of the sense strand of Dicer substrate improved the potency of synthetic duplexes in RNAi, presumably by facilitating processing by Dicer, was a surprising finding of past works describing the design and use of 25-30mer dsRNAs (also termed "DsiRNAs" herein; Rossi et al., U.S. Patent Application Nos. 2005/0277610, 2005/0244858 and 2007/0265220).

Modification of Anti-HIF-1α dsRNAs

One major factor that inhibits the effect of double stranded RNAs ("dsRNAs") is the degradation of dsRNAs (e.g., siRNAs and DsiRNAs) by nucleases. A 3'-exonuclease is the primary nuclease activity present in serum and modification of the 3'-ends of antisense DNA oligonucleotides is crucial to prevent degradation (Eder et al., 1991, *Antisense Res Dev*, 1: 141-151). An RNase-T family nuclease has been identified called ERI-1 which has 3' to 5' exonuclease activity that is involved in regulation and degradation of siRNAs (Kennedy et al., 2004, *Nature* 427: 645-649; Hong et al., 2005, *Biochem J*, 390: 675-679). This gene is also known as Thex1 (NM_02067) in mice or THEX1 (NM_153332) in humans and is involved in degradation of histone mRNA; it also mediates degradation of 3'-overhangs in siRNAs, but does not degrade duplex RNA (Yang et al., 2006, *J Biol Chem*, 281: 30447-30454). It is therefore reasonable to expect that 3'-end-stabilization of dsRNAs, including the DsiRNAs of the instant invention, will improve stability.

XRN1 (NM_019001) is a 5' to 3' exonuclease that resides in P-bodies and has been implicated in degradation of mRNA targeted by miRNA (Rehwinkel et al., 2005, *RNA* 11: 1640-1647) and may also be responsible for completing degradation initiated by internal cleavage as directed by a siRNA. XRN2 (NM_012255) is a distinct 5' to 3' exonuclease that is involved in nuclear RNA processing.

RNase A is a major endonuclease activity in mammals that degrades RNAs. It is specific for ssRNA and cleaves at the 3'-end of pyrimidine bases. SiRNA degradation products consistent with RNase A cleavage can be detected by mass spectrometry after incubation in serum (Turner et al., 2007, *Mol Biosyst* 3: 43-50). The 3'-overhangs enhance the susceptibility of siRNAs to RNase degradation. Depletion of RNase A from serum reduces degradation of siRNAs; this degradation does show some sequence preference and is worse for sequences having poly A/U sequence on the ends (Haupenthal et al., 2006 *Biochem Pharmacol* 71: 702-710). This suggests the possibility that lower stability regions of the duplex may "breathe" and offer transient single-stranded species available for degradation by RNase A. RNase A inhibitors can be added to serum and improve siRNA longevity and potency (Haupenthal et al., 2007, *Int J. Cancer* 121: 206-210).

In 21mers, phosphorothioate or boranophosphate modifications directly stabilize the internucleoside phosphate linkage. Boranophosphate modified RNAs are highly nuclease resistant, potent as silencing agents, and are relatively non-toxic. Boranophosphate modified RNAs cannot be manufactured using standard chemical synthesis methods and instead are made by in vitro transcription (IVT) (Hall et al., 2004, *Nucleic Acids Res* 32: 5991-6000; Hall et al., 2006, *Nucleic Acids Res* 34: 2773-2781). Phosphorothioate (PS) modifications can be easily placed in the RNA duplex at any desired position and can be made using standard chemical synthesis methods. The PS modification shows dose-dependent toxicity, so most investigators have recommended limited incorporation in siRNAs, favoring the 3'-ends where protection from nucleases is most important (Harborth et al., 2003, *Antisense Nucleic Acid Drug Dev* 13: 83-105; Chiu and Rana, 2003, *Mol Cell* 10: 549-561; Braasch et al., 2003, *Biochemistry* 42: 7967-7975; Amarzguioui et al., 2003, *Nucleic Acids Research* 31: 589-595). More extensive PS modification can be compatible with potent RNAi activity; however, use of sugar modifications (such as 2'-O-methyl RNA) may be superior (Choung et al., 2006, *Biochem Biophys Res Commun* 342: 919-927).

A variety of substitutions can be placed at the 2'-position of the ribose which generally increases duplex stability ($T_m$) and can greatly improve nuclease resistance. 2'-O-methyl RNA is a naturally occurring modification found in mammalian ribosomal RNAs and transfer RNAs. 2'-O-methyl modification in siRNAs is known, but the precise position of modified bases within the duplex is important to retain potency and complete substitution of 2'-O-methyl RNA for RNA will inactivate the siRNA. For example, a pattern that employs alternating 2'-O-methyl bases can have potency equivalent to unmodified RNA and is quite stable in serum (Choung et al., 2006, *Biochem Biophys Res Commun* 342: 919-927; Czauderna et al., 2003, *Nucleic Acids Research* 31: 2705-2716).

The 2'-fluoro (2'-F) modification is also compatible with dsRNA (e.g., siRNA and DsiRNA) function; it is most commonly placed at pyrimidine sites (due to reagent cost and availability) and can be combined with 2'-O-methyl modification at purine positions; 2'-F purines are available and can also be used. Heavily modified duplexes of this kind can be potent triggers of RNAi in vitro (Allerson et al., 2005, *J Med Chem* 48: 901-904; Prakash et al., 2005, *J Med Chem* 48: 4247-4253; Kraynack and Baker, 2006, *RNA* 12: 163-176) and can improve performance and extend duration of action when used in vivo (Morrissey et al., 2005, *Hepatology* 41: 1349-1356; Morrissey et al., 2005, *Nat Biotechnol* 23: 1002-1007). A highly potent, nuclease stable, blunt 19mer duplex containing alternative 2'-F and 2'-O-Me bases is taught by Allerson. In this design, alternating 2'-O-Me residues are positioned in an identical pattern to that employed by Czauderna, however the remaining RNA residues are converted to 2'-F modified bases. A highly potent, nuclease resistant siRNA employed by Morrissey employed a highly potent, nuclease resistant siRNA in vivo. In addition to 2'-O-Me RNA and 2'-F RNA, this duplex includes DNA, RNA, inverted abasic residues, and a 3'-terminal PS internucleoside linkage. While extensive modification has certain benefits, more limited modification of the duplex can also improve in vivo performance and is both simpler and less costly to manufacture. Soutschek et al. (2004, *Nature* 432: 173-178) employed a duplex in vivo and was mostly RNA with two 2'-O-Me RNA bases and limited 3'-terminal PS internucleoside linkages.

Locked nucleic acids (LNAs) are a different class of 2'-modification that can be used to stabilize dsRNA (e.g., siRNA and DsiRNA). Patterns of LNA incorporation that retain potency are more restricted than 2'-O-methyl or 2'-F bases, so limited modification is preferred (Braasch et al., 2003, *Biochemistry* 42: 7967-7975; Grunweller et al., 2003, *Nucleic Acids Res* 31: 3185-3193; Elmen et al., 2005, *Nucleic Acids Res* 33: 439-447). Even with limited incorporation, the use of LNA modifications can improve dsRNA performance in vivo and may also alter or improve off target effect profiles (Mook et al., 2007, *Mol Cancer Ther* 6: 833-843).

Synthetic nucleic acids introduced into cells or live animals can be recognized as "foreign" and trigger an immune response. Immune stimulation constitutes a major class of off-target effects which can dramatically change experimental results and even lead to cell death. The innate immune system includes a collection of receptor molecules that specifically interact with DNA and RNA that mediate these responses, some of which are located in the cytoplasm and some of which reside in endosomes (Marques and Williams, 2005, *Nat Biotechnol* 23: 1399-1405; Schlee et al., 2006, *Mol Ther* 14: 463-470). Delivery of siRNAs by cationic lipids or liposomes exposes the siRNA to both cytoplasmic and endosomal compartments, maximizing the risk for triggering a type 1 interferon (IFN) response both in vitro and in vivo (Morrissey et al., 2005, *Nat Biotechnol* 23: 1002-1007; Sioud and Sorensen, 2003, *Biochem Biophys Res Commun* 312: 1220-1225; Sioud, 2005, *J Mol Biol* 348: 1079-1090; Ma et al., 2005, *Biochem Biophys Res Commun* 330: 755-759). RNAs transcribed within the cell are less immunogenic (Robbins et al., 2006, *Nat Biotechnol* 24: 566-571) and synthetic RNAs that are immunogenic when delivered using lipid-based methods can evade immune stimulation when introduced unto cells by mechanical means, even in vivo (Heidel et al., 2004, *Nat Biotechnol* 22: 1579-1582). However, lipid based delivery methods are convenient, effective, and widely used. Some general strategy to prevent immune responses is needed, especially for in vivo application where all cell types are present and the risk of generating an immune response is highest. Use of chemically modified RNAs may solve most or even all of these problems.

In certain embodiments, modifications can be included in the anti-HIF-1α dsRNA agents of the present invention so long as the modification does not prevent the dsRNA agent from possessing HIF-1α inhibitory activity. In one embodiment, one or more modifications are made that enhance Dicer processing of the DsiRNA agent (an assay for determining Dicer processing of a DsiRNA is described elsewhere herein). In a second embodiment, one or more modifications are made that result in more effective HIF-1α inhibition (as described herein, HIF-1α inhibition/HIF-1α inhibitory activity of a dsRNA can be assayed via art-recognized methods for determining RNA levels, or for determining HIF-1α polypeptide levels, should such levels be assessed in lieu of or in addition to assessment of, e.g., HIF-1α mRNA levels). In a third embodiment, one or more modifications are made that support greater HIF-1α inhibitory activity (means of determining HIF-1α inhibitory activity are described supra). In a fourth embodiment, one or more modifications are made that result in greater potency of HIF-1α inhibitory activity per each dsRNA agent molecule to be delivered to the cell (potency of HIF-1α inhibitory activity is described supra). Modifications can be incorporated in the 3'-terminal region, the 5'-terminal region, in both the 3'-terminal and 5'-terminal region or in some instances in various positions within the sequence. With the restrictions noted above in mind, numbers and combinations of modifications can be incorporated into the dsRNA agent. Where multiple modifications are present, they may be the same or different. Modifications to bases, sugar moieties, the phosphate backbone, and their combinations are contemplated. Either 5'-terminus can be phosphorylated.

Examples of modifications contemplated for the phosphate backbone include phosphonates, including methylphosphonate, phosphorothioate, and phosphotriester modifications such as alkylphosphotriesters, and the like. Examples of modifications contemplated for the sugar moiety include 2'-alkyl pyrimidine, such as 2'-O-methyl, 2'-fluoro, amino, and deoxy modifications and the like (see, e.g., Amarzguioui et al., 2003, *Nucleic Acids Research* 31: 589-595). Examples of modifications contemplated for the base groups include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated. Many other modifications are known and can be used so long as the above criteria are satisfied. Examples of modifications are also disclosed in U.S. Pat. Nos. 5,684,143, 5,858,988 and 6,291,438 and in U.S. published patent application No. 2004/0203145 A1. Other modifications are disclosed in Herdewijn (2000, *Antisense Nucleic Acid Drug Dev* 10: 297-310), Eckstein (2000, *Antisense Nucleic Acid Drug Dev* 10: 117-21), Rusckowski et al. (2000, *Antisense Nucleic Acid Drug Dev* 10: 333-345), Stein et al. (2001, *Antisense Nucleic Acid Drug Dev* 11: 317-25); Vorobjev et al. (2001, *Antisense Nucleic Acid Drug Dev* 11: 77-85).

One or more modifications contemplated can be incorporated into either strand. The placement of the modifications in the dsRNA agent can greatly affect the characteristics of the dsRNA agent, including conferring greater potency and stability, reducing toxicity, enhance Dicer processing, and minimizing an immune response. In one embodiment, the antisense strand or the sense strand or both strands have one or more 2'-O-methyl modified nucleotides. In another embodiment, the antisense strand contains 2'-O-methyl modified nucleotides. In another embodiment, the antisense stand contains a 3' overhang that is comprised of 2'-O-methyl modified nucleotides. The antisense strand could also include additional 2'-O-methyl modified nucleotides.

In certain embodiments, the anti-HIF-1α DsiRNA agent of the invention has several properties which enhance its processing by Dicer. According to such embodiments, the DsiRNA agent has a length sufficient such that it is processed by Dicer to produce an siRNA and at least one of the following properties: (i) the DsiRNA agent is asymmetric, e.g., has a 3' overhang on the sense strand and (ii) the DsiRNA agent has a modified 3' end on the antisense strand to direct orientation of Dicer binding and processing of the dsRNA to an active siRNA. According to these embodiments, the longest strand in the DsiRNA agent comprises 25-30 nucleotides. In one embodiment, the sense strand comprises 25-30 nucleotides and the antisense strand comprises 25-28 nucleotides. Thus, the resulting dsRNA has an overhang on the 3' end of the sense strand. The overhang is 1-4 nucleotides, such as 2 nucleotides. The antisense strand may also have a 5' phosphate.

In certain embodiments, the sense strand of a DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the sense strand in place of two ribonucleotides forming a blunt end of the duplex on the 5' end of the antisense strand and the 3' end of the sense strand, and a two-nucleotide RNA overhang is located on the 3'-end of the antisense strand. This is an asymmetric composition with DNA on the blunt end and RNA bases on the overhanging end.

In certain other embodiments, the antisense strand of a DsiRNA agent is modified for Dicer processing by suitable modifiers located at the 3' end of the antisense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the antisense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is also an asymmetric composition with DNA on the blunt end and RNA bases on the overhanging end.

The sense and antisense strands anneal under biological conditions, such as the conditions found in the cytoplasm of a cell. In addition, a region of one of the sequences, particularly of the antisense strand, of the dsRNA has a sequence length of at least 19 nucleotides, wherein these nucleotides are adjacent to the 3' end of antisense strand and are sufficiently complementary to a nucleotide sequence of the target HIF-1α RNA.

Additionally, the DsiRNA agent structure can be optimized to ensure that the oligonucleotide segment generated from Dicer's cleavage will be the portion of the oligonucleotide that is most effective in inhibiting gene expression. For example, in one embodiment of the invention, a 27-bp oligonucleotide of the DsiRNA agent structure is synthesized wherein the anticipated 21 to 22-bp segment that will inhibit gene expression is located on the 3'-end of the antisense strand. The remaining bases located on the 5'-end of the antisense strand will be cleaved by Dicer and will be discarded. This cleaved portion can be homologous (i.e., based on the sequence of the target sequence) or non-homologous and added to extend the nucleic acid strand.

US 2007/0265220 discloses that 27mer DsiRNAs show improved stability in serum over comparable 21mer siRNA compositions, even absent chemical modification. Modifications of DsiRNA agents, such as inclusion of 2'-O-methyl RNA in the antisense strand, in patterns such as detailed above, when coupled with addition of a 5' Phosphate, can improve stability of DsiRNA agents. Addition of 5'-phosphate to all strands in synthetic RNA duplexes may be an inexpensive and physiological method to confer some limited degree of nuclease stability.

The chemical modification patterns of the dsRNA agents of the instant invention are designed to enhance the efficacy of such agents. Accordingly, such modifications are designed to avoid reducing potency of dsRNA agents; to avoid interfering with Dicer processing of DsiRNA agents; to improve stability in biological fluids (reduce nuclease sensitivity) of dsRNA agents; or to block or evade detection by the innate immune system. Such modifications are also designed to avoid being toxic and to avoid increasing the cost or impact the ease of manufacturing the instant dsRNA agents of the invention.

In certain embodiments of the present invention, an anti-HIF-1α DsiRNA agent has one or more of the following properties: (i) the DsiRNA agent is asymmetric, e.g., has a 3' overhang on the antisense strand and (ii) the DsiRNA agent has a modified 3' end on the sense strand to direct orientation of Dicer binding and processing of the dsRNA to an active siRNA. According to this embodiment, the longest strand in the dsRNA comprises 25-35 nucleotides (e.g., 25, 26, 27, 28, 29, 30, 31, 32, 33, 34 or 35 nucleotides). In certain such embodiments, the DsiRNA agent is asymmetric such that the sense strand comprises 25-34 nucleotides and the 3' end of the sense strand forms a blunt end with the 5' end of the antisense strand while the antisense strand comprises 26-35 nucleotides and forms an overhang on the 3' end of the antisense strand. In one embodiment, the DsiRNA agent is asymmetric such that the sense strand comprises 25-28 nucleotides and the antisense strand comprises 25-30 nucleotides. Thus, the resulting dsRNA has an overhang on the 3' end of the antisense strand. The overhang is 1-4 nucleotides, for example 2 nucleotides. The sense strand may also have a 5' phosphate.

The DsiRNA agent can also have one or more of the following additional properties: (a) the antisense strand has a right shift from the typical 21mer (e.g., the DsiRNA comprises a length of antisense strand nucleotides that extends to the 5' of a projected Dicer cleavage site within the DsiRNA, with such antisense strand nucleotides base paired with corresponding nucleotides of the sense strand extending 3' of a projected Dicer cleavage site in the sense strand), (b) the strands may not be completely complementary, i.e., the strands may contain simple mismatched base pairs (in certain embodiments, the DsiRNAs of the invention possess 1, 2, 3, 4 or even 5 or more mismatched base pairs, provided that HIF-1α inhibitory activity of the DsiRNA possessing mismatched base pairs is retained at sufficient levels (e.g., retains at least 50% HIF-1α inhibitory activity or more, at least 60% HIF-1α inhibitory activity or more, at least 70% HIF-1α inhibitory activity or more, at least 80% HIF-1α inhibitory activity or more, at least 90% HIF-1α inhibitory activity or more or at least 95% HIF-1α inhibitory activity or more as compared to a corresponding DsiRNA not possessing mismatched base pairs. In certain embodiments, mismatched base pairs exist between the antisense and sense strands of a DsiRNA. In some embodiments, mismatched base pairs exist (or are predicted to exist) between the antisense strand and the target RNA. In certain embodiments, the presence of a mismatched base pair(s) between an antisense strand residue and a corresponding residue within the target RNA that is located 3' in the target RNA sequence of a projected Ago2 cleavage site retains and may even enhance HIF-1α inhibitory activity of a DsiRNA of the invention) and (c) base modifications such as locked nucleic acid(s) may be included in the 5' end of the sense strand. A "typical" 21mer siRNA is designed using conventional techniques. In one technique, a variety of sites are commonly tested in parallel or pools containing several distinct siRNA duplexes specific to the same target with the hope that one of the reagents will be effective (Ji et al., 2003, *FEBS Lett* 552: 247-252). Other techniques use design rules and algorithms to increase the likelihood of obtaining active RNAi effector molecules (Schwarz et al., 2003, *Cell* 115: 199-208; Khvorova et al., 2003, *Cell* 115: 209-216; Ui-Tei et al., 2004, *Nucleic Acids Res* 32: 936-948; Reynolds et al., 2004, *Nat Biotechnol* 22: 326-330; Krol et al., 2004, *J Biol Chem* 279: 42230-42239; Yuan et al., 2004, *Nucl Acids Res* 32(Webserver issue):W130-134; Boese et al., 2005, *Methods Enzymol* 392: 73-96). High throughput selection of siRNA has also been developed (U.S. published patent application No. 2005/0042641 A1). Potential target sites can also be analyzed by secondary structure predictions (Heale et al., 2005, *Nucleic Acids Res* 33(3): e30). This 21mer is then used to design a right shift to include 3-9 additional nucleotides on the 5' end of the 21mer. The sequence of these additional nucleotides is not restricted. In one embodiment, the added ribonucleotides are based on the sequence of the target gene. Even in this embodiment, full complementarity between the target sequence and the antisense siRNA is not required.

The first and second oligonucleotides of a DsiRNA agent of the instant invention are not required to be completely complementary. They only need to be sufficiently complementary to anneal under biological conditions and to provide a substrate for Dicer that produces a siRNA sufficiently complementary to the target sequence. Locked nucleic acids, or LNA's, are well known to a skilled artisan (Elmen et al., 2005, *Nucleic Acids Res* 33: 439-447; Kurreck et al., 2002, *Nucleic Acids Res* 30: 1911-1918; Crinelli et al., 2002, *Nucleic Acids Res* 30: 2435-2443; Braasch and Corey, 2001, *Chem Biol* 8: 1-7; Bondensgaard et al., 2000, *Chemistry* 6: 2687-2695; Wahlestedt et al., 2000, *Proc Natl Acad Sci USA* 97: 5633-5638). In one embodiment, an LNA is incorporated at the 5' terminus of the sense strand. In another embodiment, an LNA is incorporated at the 5' terminus of the sense strand in duplexes designed to include a 3' overhang on the antisense strand.

In certain embodiments, the DsiRNA agent of the instant invention has an asymmetric structure, with the sense strand having a 25-base pair length, and the antisense strand having a 27-base pair length with a 2 base 3'-overhang. In other embodiments, this DsiRNA agent having an asymmetric structure further contains 2 deoxynucleotides at the 3' end of the sense strand in place of two of the ribonucleotides.

Certain DsiRNA agent compositions containing two separate oligonucleotides can be linked by a third structure. The third structure will not block Dicer activity on the DsiRNA agent and will not interfere with the directed destruction of the RNA transcribed from the target gene. In one embodiment, the third structure may be a chemical linking group. Many suitable chemical linking groups are known in the art and can be used. Alternatively, the third structure may be an oligonucleotide that links the two oligonucleotides of the DsiRNA agent in a manner such that a hairpin structure is produced upon annealing of the two oligonucleotides making up the dsRNA composition. The hairpin structure will not block Dicer activity on the DsiRNA agent and will not interfere with the directed destruction of the HIF-1α RNA.

HIF-1α cDNA and Polypeptide Sequences

Known human and mouse HIF-1α cDNA and polypeptide sequences include the following: human wild-type Hypoxia Inducible Factor 1, alpha subunit (basic helix-loop-helix transcription factor; HIF-1α) cDNA sequences GenBank Accession Nos. NM_001530.3 (transcript variant 1) and NM_181054.2 (transcript variant 2); corresponding human HIF-1α polypeptide sequences GenBank Accession Nos. NP_001521.1 (transcript variant 1) and NP_851397.1 (transcript variant 2); mouse wild-type HIF-1α sequence GenBank Accession No. NM_010431.2 (*Mus musculus* C57BL/6 HIF-1α transcript) and corresponding mouse HIF-1α polypeptide sequence GenBank Accession No. NP_034561.2.

In Vitro Assay to Assess dsRNA HIF-1α Inhibitory Activity

An in vitro assay that recapitulates RNAi in a cell-free system can be used to evaluate dsRNA constructs targeting HIF-1α RNA sequence(s), and thus to assess HIF-1α-specific gene inhibitory activity (also referred to herein as HIF-1α inhibitory activity) of a dsRNA. The assay comprises the system described by Tuschl et al., 1999, Genes and Development, 13, 3191-3197 and Zamore et al., 2000, Cell, 101, 25-33 adapted for use with dsRNA (e.g., DsiRNA) agents directed against HIF-1α RNA. A *Drosophila* extract derived from syncytial blastoderm is used to reconstitute RNAi activity in vitro. Target RNA is generated via in vitro transcription from a selected HIF-1α expressing plasmid using T7 RNA polymerase or via chemical synthesis. Sense and antisense dsRNA strands (for example, 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing dsRNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and preincubated at 25° C. for 10 minutes before adding RNA, then incubated at 25° C. for an additional 60 minutes. Reactions are quenched with 4 volumes of 1.25× Passive Lysis Buffer (Promega). Target RNA cleavage is assayed by RT-PCR analysis or other methods known in the art and are compared to control reactions in which dsRNA is omitted from the reaction.

Alternately, internally-labeled target RNA for the assay is prepared by in vitro transcription in the presence of $[\alpha\text{-}^{32}P]$ CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without dsRNA and the cleavage products generated by the assay.

In one embodiment, this assay is used to determine target sites in the HIF-1α RNA target for dsRNA mediated RNAi cleavage, wherein a plurality of dsRNA constructs are screened for RNAi mediated cleavage of the HIF-1α RNA target, for example, by analyzing the assay reaction by electrophoresis of labeled target RNA, or by northern blotting, as well as by other methodology well known in the art.

In certain embodiments, a dsRNA of the invention is deemed to possess HIF-1α inhibitory activity if, e.g., a 50% reduction in HIF-1α RNA levels is observed in a system, cell, tissue or organism, relative to a suitable control. Additional metes and bounds for determination of HIF-1α inhibitory activity of a dsRNA of the invention are described supra.

Conjugation and Delivery of Anti-HIF-1α dsRNA Agents

In certain embodiments the present invention relates to a method for treating a subject having a HIF-1α-associated disease or disorder, or at risk of developing a HIF-1α-associated disease or disorder. In such embodiments, the dsRNA can act as novel therapeutic agents for controlling the HIF-1α-associated disease or disorder. The method comprises administering a pharmaceutical composition of the invention to the patient (e.g., human), such that the expression, level and/or activity of a HIF-1α RNA is reduced. The expression, level and/or activity of a polypeptide encoded by a HIF-1α RNA might also be reduced by a dsRNA of the instant invention, even where said dsRNA is directed against a non-coding region of the HIF-1α transcript (e.g., a targeted 5' UTR or 3' UTR sequence). Because of their high specificity, the dsRNAs of the present invention can specifically target HIF-1α sequences of cells and tissues, optionally in an allele-specific manner where polymorphic alleles exist within an individual and/or population.

In the treatment of a HIF-1α-associated disease or disorder, the dsRNA can be brought into contact with the cells or tissue of a subject, e.g., the cells or tissue of a subject exhibiting disregulation of HIF-1α and/or otherwise targeted for reduction of HIF-1α levels. For example, dsRNA substantially identical to all or part of a HIF-1α RNA sequence, may be brought into contact with or introduced into such a cell, either in vivo or in vitro. Similarly, dsRNA substantially identical to all or part of a HIF-1α RNA sequence may administered directly to a subject having or at risk of developing a HIF-1α-associated disease or disorder.

Therapeutic use of the dsRNA agents of the instant invention can involve use of formulations of dsRNA agents comprising multiple different dsRNA agent sequences. For example, two or more, three or more, four or more, five or more, etc. of the presently described agents can be combined to produce a formulation that, e.g., targets multiple different regions of the HIF-1α RNA, or that not only target HIF-1α RNA but also target, e.g., cellular target genes associated with a HIF-1α-associated disease or disorder. A dsRNA agent of the instant invention may also be constructed such that either strand of the dsRNA agent independently targets two or more regions of HIF-1α RNA, or such that one of the strands of the dsRNA agent targets a cellular target gene of HIF-1α known in the art.

Use of multifunctional dsRNA molecules that target more then one region of a target nucleic acid molecule can also provide potent inhibition of HIF-1α RNA levels and expression. For example, a single multifunctional dsRNA construct of the invention can target both the HIF-1α-1385 and HIF-1α-4012 sites simultaneously; additionally and/or alternatively, single or multifunctional agents of the invention can be designed to selectively target one splice variant of HIF-1α over another.

Thus, the dsRNA agents of the instant invention, individually, or in combination or in conjunction with other drugs, can be used to treat, inhibit, reduce, or prevent a HIF-1α-associated disease or disorder. For example, the dsRNA molecules can be administered to a subject or can be administered to other appropriate cells evident to those skilled in the art, individually or in combination with one or more drugs under conditions suitable for the treatment.

The dsRNA molecules also can be used in combination with other known treatments to treat, inhibit, reduce, or prevent a HIF-1α-associated disease or disorder in a subject or organism. For example, the described molecules could be used in combination with one or more known compounds, treatments, or procedures to treat, inhibit, reduce, or prevent a HIF-1α-associated disease or disorder in a subject or organism as are known in the art.

A dsRNA agent of the invention can be conjugated (e.g., at its 5' or 3' terminus of its sense or antisense strand) or unconjugated to another moiety (e.g. a non-nucleic acid moiety such as a peptide), an organic compound (e.g., a dye, cholesterol, or the like). Modifying dsRNA agents in this way may improve cellular uptake or enhance cellular targeting activities of the resulting dsRNA agent derivative as compared to the corresponding unconjugated dsRNA agent, are useful for tracing the dsRNA agent derivative in the cell, or improve the stability of the dsRNA agent derivative compared to the corresponding unconjugated dsRNA agent.

Methods of Introducing Nucleic Acids, Vectors, and Host Cells dsRNA agents of the invention may be directly introduced into a cell (i.e., intracellularly); or introduced extracellularly into a cavity, interstitial space, into the circulation of an organism, introduced orally, or may be introduced by bathing a cell or organism in a solution containing the nucleic acid. Vascular or extravascular circulation, the blood or lymph system, and the cerebrospinal fluid are sites where the nucleic acid may be introduced.

The dsRNA agents of the invention can be introduced using nucleic acid delivery methods known in art including injection of a solution containing the nucleic acid, bombardment by particles covered by the nucleic acid, soaking the cell or organism in a solution of the nucleic acid, or electroporation of cell membranes in the presence of the nucleic acid. Other methods known in the art for introducing nucleic acids to cells may be used, such as lipid-mediated carrier transport, chemical-mediated transport, and cationic liposome transfection such as calcium phosphate, and the like. The nucleic acid may be introduced along with other components that perform one or more of the following activities: enhance nucleic acid uptake by the cell or otherwise increase inhibition of the target HIF-1α RNA.

A cell having a target HIF-1α RNA may be from the germ line or somatic, totipotent or pluripotent, dividing or non-dividing, parenchyma or epithelium, immortalized or transformed, or the like. The cell may be a stem cell or a differentiated cell. Cell types that are differentiated include adipocytes, fibroblasts, myocytes, cardiomyocytes, endothelium, neurons, glia, blood cells, megakaryocytes, lymphocytes, macrophages, neutrophils, eosinophils, basophils, mast cells, leukocytes, granulocytes, keratinocytes, chondrocytes, osteoblasts, osteoclasts, hepatocytes, and cells of the endocrine or exocrine glands.

Depending on the particular target HIF-1α RNA sequence and the dose of dsRNA agent material delivered, this process may provide partial or complete loss of function for the HIF-1α RNA. A reduction or loss of RNA levels or expression (either HIF-1α RNA expression or encoded polypeptide expression) in at least 50%, 60%, 70%, 80%, 90%, 95% or 99% or more of targeted cells is exemplary Inhibition of HIF-1α RNA levels or expression refers to the absence (or observable decrease) in the level of HIF-1α RNA or HIF-1α RNA-encoded protein. Specificity refers to the ability to inhibit the HIF-1α RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS). Inhibition of target HIF-1α RNA sequence(s) by the dsRNA agents of the invention also can be measured based upon the effect of administration of such dsRNA agents upon development/progression of a HIF-1α-associated disease or disorder, e.g., tumor formation, growth, metastasis, etc., either in vivo or in vitro. Treatment and/or reductions in tumor or cancer cell levels can include halting or reduction of growth of tumor or cancer cell levels or reductions of, e.g., 10%, 20%, 30%, 40%, 50%, 60%, 70%, 80%, 90%, 95% or 99% or more, and can also be measured in logarithmic terms, e.g., 10-fold, 100-fold, 1000-fold, $10^5$-fold, $10^6$-fold, $10^7$-fold reduction in cancer cell levels could be achieved via administration of the dsRNA agents of the invention to cells, a tissue, or a subject.

For RNA-mediated inhibition in a cell line or whole organism, expression a reporter or drug resistance gene whose protein product is easily assayed can be measured. Such reporter genes include acetohydroxyacid synthase (AHAS), alkaline phosphatase (AP), beta galactosidase (LacZ), beta glucoronidase (GUS), chloramphenicol acetyltransferase (CAT), green fluorescent protein (GFP), horseradish peroxidase (HRP), luciferase (Luc), nopaline synthase (NOS), octopine synthase (OCS), and derivatives thereof. Multiple selectable markers are available that confer resistance to ampicillin, bleomycin, chloramphenicol, gentamycin, hygromycin, kanamycin, lincomycin, methotrexate, phosphinothricin, puromycin, and tetracyclin. Depending on the assay, quantitation of the amount of gene expression allows one to determine a degree of inhibition which is greater than 10%, 33%, 50%, 90%, 95% or 99% as compared to a cell not treated according to the present invention.

Lower doses of injected material and longer times after administration of RNA silencing agent may result in inhibition in a smaller fraction of cells (e.g., at least 10%, 20%, 50%, 75%, 90%, or 95% of targeted cells). Quantitation of gene expression in a cell may show similar amounts of inhibition at the level of accumulation of target HIF-1α RNA or translation of target protein. As an example, the efficiency of inhibition may be determined by assessing the amount of gene product in the cell; RNA may be detected with a hybridization probe having a nucleotide sequence outside the region used for the inhibitory dsRNA, or translated polypeptide may be detected with an antibody raised against the polypeptide sequence of that region.

The dsRNA agent may be introduced in an amount which allows delivery of at least one copy per cell. Higher doses (e.g., at least 5, 10, 100, 500 or 1000 copies per cell) of material may yield more effective inhibition; lower doses may also be useful for specific applications.

Pharmaceutical Compositions

In certain embodiments, the present invention provides for a pharmaceutical composition comprising the dsRNA agent of the present invention. The dsRNA agent sample can be suitably formulated and introduced into the environment of the cell by any means that allows for a sufficient portion of the sample to enter the cell to induce gene silencing, if it is to occur. Many formulations for dsRNA are known in the art and can be used so long as the dsRNA gains entry to the target cells so that it can act. See, e.g., U.S. published patent application Nos. 2004/0203145 A1 and 2005/0054598 A1. For example, the dsRNA agent of the instant invention can be formulated in buffer solutions such as phosphate buffered saline solutions, liposomes, micellar structures, and capsids. Formulations of dsRNA agent with cationic lipids can be used to facilitate transfection of the dsRNA agent into cells. For example, cationic lipids, such as lipofectin (U.S. Pat. No. 5,705,188), cationic glycerol derivatives, and polycationic molecules, such as polylysine (published PCT International Application WO 97/30731), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Such compositions typically include the nucleic acid molecule and a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; cHeLating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in a selected solvent with one or a combination of ingredients enumerated above, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer. Such methods include those described in U.S. Pat. No. 6,468,798.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

The compounds can also be administered by transfection or infection using methods known in the art, including but not limited to the methods described in McCaffrey et al. (2002), Nature, 418(6893), 38-9 (hydrodynamic transfection); Xia et al. (2002), Nature Biotechnol., 20(10), 1006-10 (viral-mediated delivery); or Putnam (1996), Am. J. Health Syst. Pharm. 53(2), 151-160, erratum at Am. J. Health Syst. Pharm. 53(3), 325 (1996).

The compounds can also be administered by a method suitable for administration of nucleic acid agents, such as a DNA vaccine. These methods include gene guns, bio injectors, and skin patches as well as needle-free methods such as the micro-particle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of a nucleic acid molecule (i.e., an effective dosage) depends on the nucleic acid selected. For instance, single dose amounts of a dsRNA (or, e.g., a construct(s) encoding for such dsRNA) in the range of approximately 1 pg to 1000 mg may be administered; in some embodiments, 10, 30, 100, or 1000 pg, or 10, 30, 100, or 1000 ng, or 10, 30, 100, or 1000 μg, or 10, 30, 100, or 1000 mg may be administered. In some embodiments, 1-5 g of the compositions can be administered. The compositions can be administered one from one or more times per day to one or more times per week; including once every other day. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a nucleic acid (e.g., dsRNA), protein, polypeptide, or antibody can include a single treatment or, preferably, can include a series of treatments.

The nucleic acid molecules of the invention can be inserted into expression constructs, e.g., viral vectors, retroviral vectors, expression cassettes, or plasmid viral vectors, e.g., using methods known in the art, including but not limited to those described in Xia et al., (2002), supra. Expression constructs can be delivered to a subject by, for example, inhalation, orally, intravenous injection, local administration (see U.S. Pat. No. 5,328,470) or by stereotactic injection (see e.g., Chen et al. (1994), Proc. Natl. Acad. Sci. USA, 91, 3054-3057). The pharmaceutical preparation of the delivery vector can include the vector in an acceptable diluent, or can comprise a slow release matrix in which the delivery vehicle is imbedded. Alternatively, where the complete delivery vector can be produced intact from recombinant cells, e.g., retroviral vectors, the pharmaceutical preparation can include one or more cells which produce the gene delivery system.

The expression constructs may be constructs suitable for use in the appropriate expression system and include, but are not limited to retroviral vectors, linear expression cassettes, plasmids and viral or virally-derived vectors, as known in the art. Such expression constructs may include one or more inducible promoters, RNA Pol III promoter systems such as U6 snRNA promoters or H1 RNA polymerase III promoters, or other promoters known in the art. The constructs can include one or both strands of the siRNA. Expression constructs expressing both strands can also include loop structures linking both strands, or each strand can be separately transcribed from separate promoters within the same construct. Each strand can also be transcribed from a separate expression construct, e.g., Tuschl (2002, *Nature Biotechnol* 20: 500-505).

It can be appreciated that the method of introducing dsRNA agents into the environment of the cell will depend on the type of cell and the make up of its environment. For example, when the cells are found within a liquid, one preferable formulation is with a lipid formulation such as in lipofectamine and the dsRNA agents can be added directly to the liquid environment of the cells. Lipid formulations can also be administered to animals such as by intravenous, intramuscular, or intraperitoneal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate dsRNA agents in a buffer or saline solution and directly inject the formulated dsRNA agents into cells, as in studies with oocytes. The direct injection of dsRNA agent duplexes may also be done. For suitable methods of introducing dsRNA (e.g., DsiRNA agents), see U.S. published patent application No. 2004/0203145 A1.

Suitable amounts of a dsRNA agent must be introduced and these amounts can be empirically determined using standard methods. Typically, effective concentrations of individual dsRNA agent species in the environment of a cell will be 50 nanomolar or less, 10 nanomolar or less, or compositions in which concentrations of 1 nanomolar or less can be used. In another embodiment, methods utilizing a concentration of 200 picomolar or less, 100 picomolar or less, 50 picomolar or less, 20 picomolar or less, and even a concentration of 10 picomolar or less, 5 picomolar or less, 2 picomolar or less or 1 picomolar or less can be used in many circumstances.

The method can be carried out by addition of the dsRNA agent compositions to an extracellular matrix in which cells can live provided that the dsRNA agent composition is formulated so that a sufficient amount of the dsRNA agent can enter the cell to exert its effect. For example, the method is amenable for use with cells present in a liquid such as a liquid culture or cell growth media, in tissue explants, or in whole organisms, including animals, such as mammals and especially humans.

The level or activity of a HIF-1α RNA can be determined by a suitable method now known in the art or that is later developed. It can be appreciated that the method used to measure a target RNA and/or the expression of a target RNA can depend upon the nature of the target RNA. For example, where the target HIF-1α RNA sequence encodes a protein, the term "expression" can refer to a protein or the HIF-1α RNA/transcript derived from the HIF-1α gene (either genomic or of exogenous origin). In such instances the expression of the target HIF-1α RNA can be determined by measuring the amount of HIF-1α RNA/transcript directly or by measuring the amount of HIF-1α protein. Protein can be measured in protein assays such as by staining or immunoblotting or, if the protein catalyzes a reaction that can be measured, by measuring reaction rates. All such methods are known in the art and can be used. Where target HIF-1α RNA levels are to be measured, art-recognized methods for detecting RNA levels can be used (e.g., RT-PCR, Northern Blotting, etc.). In targeting HIF-1α RNAs with the dsRNA agents of the instant invention, it is also anticipated that measurement of the efficacy of a dsRNA agent in reducing levels of HIF-1α RNA or protein in a subject, tissue, in cells, either in vitro or in vivo, or in cell extracts can also be used to determine the extent of reduction of HIF-1α-associated phenotypes (e.g., disease or disorders, e.g., cancer or tumor formation, growth, metastasis, spread, etc.). The above measurements can be made on cells, cell extracts, tissues, tissue extracts or other suitable source material.

The determination of whether the expression of a HIF-1α RNA has been reduced can be by a suitable method that can reliably detect changes in RNA levels. Typically, the determination is made by introducing into the environment of a cell undigested dsRNA such that at least a portion of that dsRNA agent enters the cytoplasm, and then measuring the level of the target RNA. The same measurement is made on identical untreated cells and the results obtained from each measurement are compared.

The dsRNA agent can be formulated as a pharmaceutical composition which comprises a pharmacologically effective amount of a dsRNA agent and pharmaceutically acceptable carrier. A pharmacologically or therapeutically effective amount refers to that amount of a dsRNA agent effective to produce the intended pharmacological, therapeutic or preventive result. The phrases "pharmacologically effective amount" and "therapeutically effective amount" or simply "effective amount" refer to that amount of an RNA effective to produce the intended pharmacological, therapeutic or preventive result. For example, if a given clinical treatment is considered effective when there is at least a 20% reduction in a measurable parameter associated with a disease or disorder, a therapeutically effective amount of a drug for the treatment of that disease or disorder is the amount necessary to effect at least a 20% reduction in that parameter.

Suitably formulated pharmaceutical compositions of this invention can be administered by means known in the art such as by parenteral routes, including intravenous, intramuscular, intraperitoneal, subcutaneous, transdermal, airway (aerosol), rectal, vaginal and topical (including buccal and sublingual) administration. In some embodiments, the pharmaceutical compositions are administered by intravenous or intraparenteral infusion or injection.

In general, a suitable dosage unit of dsRNA will be in the range of 0.001 to 0.25 milligrams per kilogram body weight of the recipient per day, or in the range of 0.01 to 20 micrograms per kilogram body weight per day, or in the range of 0.001 to 5 micrograms per kilogram of body weight per day, or in the range of 1 to 500 nanograms per kilogram of body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day. A pharmaceutical composition comprising the dsRNA can be administered once daily. However, the therapeutic agent may also be dosed in dosage units containing two, three, four, five, six or more sub-doses administered at appropriate intervals throughout the day. In that case, the dsRNA contained in each sub-dose must be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. In this embodiment, the dosage unit contains a corresponding multiple of the daily dose. Regardless of the formulation, the pharmaceutical composition must contain dsRNA in a quantity sufficient to inhibit expression of the target gene in the animal or human being treated. The composition can be compounded in such a way that the sum of the multiple units of dsRNA together contain a sufficient dose.

Data can be obtained from cell culture assays and animal studies to formulate a suitable dosage range for humans. The dosage of compositions of the invention lies within a range of circulating concentrations that include the $ED_{50}$ (as determined by known methods) with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range of the compound that includes the $IC_{50}$ (i.e., the concentration of the test compound which achieves a half-maximal inhibition of symptoms) as determined in cell culture. Such information can be used to more accurately determine useful doses in humans. Levels of dsRNA in plasma may be measured by standard methods, for example, by high performance liquid chromatography.

The pharmaceutical compositions can be included in a kit, container, pack, or dispenser together with instructions for administration.

Methods of Treatment

The present invention provides for both prophylactic and therapeutic methods of treating a subject at risk of (or susceptible to) a disease or disorder caused, in whole or in part, by HIF-1α (e.g., misregulation and/or elevation of HIF-1α transcript and/or HIF-1α protein levels), or treatable via selective targeting of HIF-1α.

"Treatment", or "treating" as used herein, is defined as the application or administration of a therapeutic agent (e.g., a dsRNA agent or vector or transgene encoding same) to a patient, or application or administration of a therapeutic agent to an isolated tissue or cell line from a patient, who has the disease or disorder, a symptom of disease or disorder or a predisposition toward a disease or disorder, with the purpose to cure, heal, alleviate, relieve, alter, remedy, ameliorate, improve or affect the disease or disorder, the symptoms of the disease or disorder, or the predisposition toward disease.

In one aspect, the invention provides a method for preventing in a subject, a disease or disorder as described above (including, e.g., prevention of the commencement of transforming events within a subject via inhibition of HIF-1α expression), by administering to the subject a therapeutic agent (e.g., a dsRNA agent or vector or transgene encoding same). Subjects at risk for the disease can be identified by, for example, one or a combination of diagnostic or prognostic assays as described herein. Administration of a prophylactic agent can occur prior to the detection of, e.g., cancer in a subject, or the manifestation of symptoms characteristic of the disease or disorder, such that the disease or disorder is prevented or, alternatively, delayed in its progression.

Another aspect of the invention pertains to methods of treating subjects therapeutically, i.e., altering the onset of symptoms of the disease or disorder. These methods can be performed in vitro (e.g., by culturing the cell with the dsRNA agent) or, alternatively, in vivo (e.g., by administering the dsRNA agent to a subject).

With regards to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype"). Thus, another aspect of the invention provides methods for tailoring an individual's prophylactic or therapeutic treatment with either the target HIF-1α RNA molecules of the present invention or target HIF-1α RNA modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

Therapeutic agents can be tested in a selected animal model. For example, a dsRNA agent (or expression vector or transgene encoding same) as described herein can be used in an animal model to determine the efficacy, toxicity, or side effects of treatment with said agent. Alternatively, an agent (e.g., a therapeutic agent) can be used in an animal model to determine the mechanism of action of such an agent.

Models Useful to Evaluate the Down-Regulation of HIF-1α mRNA Levels and Expression Cell Culture The dsRNA agents of the invention can be tested for cleavage activity in vivo, for example, using the following procedure. The nucleotide sequences within the HIF-1α cDNA targeted by the dsRNA agents of the invention are shown in the above HIF-1α sequences.

The dsRNA reagents of the invention can be tested in cell culture using HeLa or other mammalian cells to determine the extent of HIF-1α RNA and HIF-1α protein inhibition. In certain embodiments, DsiRNA reagents (e.g., see FIG. 1, and above-recited structures) are selected against the HIF-1α target as described herein. HIF-1α RNA inhibition is measured after delivery of these reagents by a suitable transfection agent to, for example, cultured HeLa cells or other transformed or non-transformed mammalian cells in culture. Relative amounts of target HIF-1α RNA are measured versus actin or other appropriate control using real-time PCR monitoring of amplification (e.g., ABI 7700 TAQMAN®). A comparison is made to a mixture of oligonucleotide sequences made to unrelated targets or to a randomized DsiRNA control with the same overall length and chemistry, but randomly substituted at each position, or simply to appropriate vehicle-treated or untreated controls. Primary and secondary lead reagents are chosen for the target and optimization performed. After a transfection agent concentration is chosen, a RNA time-course of inhibition is performed with the lead DsiRNA molecule.

TAQMAN® (Real-Time PCR Monitoring of Amplification) and Lightcycler Quantification of mRNA Total RNA is prepared from cells following DsiRNA delivery, for example, using Ambion Rnaqueous 4-PCR purification kit for large scale extractions, or Promega SV96 for 96-well assays. For Taqman analysis, dual-labeled probes are synthesized with, for example, the reporter dyes FAM or VIC covalently linked at the 5'-end and the quencher dye TAM-HIF-1αA conjugated to the 3'-end. PCR amplifications are performed on, for example, an ABI PRISM 7700 Sequence detector using 50 uL reactions consisting of 10 uL total RNA, 100 nM forward primer, 100 mM reverse primer, 100 nM probe, 1× TaqMan PCR reaction buffer (PE-Applied Biosystems), 5.5 mM MgCl2, 100 uM each dATP, dCTP, dGTP and dTTP, 0.2 U RNase Inhibitor (Promega), 0.025 U AmpliTaq Gold (PE-Applied Biosystems) and 0.2 U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target HIF-1α mRNA level is determined relative to standards generated from serially diluted total cellular RNA (300, 100, 30, 10 ng/rxn) and normalizing to, for example, 36B4 mRNA in either parallel or same tube TaqMan reactions.

Western Blotting

Cellular protein extracts can be prepared using a standard micro preparation technique (for example using RIPA buffer), or preferably, by extracting nuclear proteins by a method such as the NE-PER Nuclear and Cytoplasmic Extraction kit (Thermo-Fisher Scientific). Cellular protein extracts are run on 4-12% Tris-Glycine polyacrylamide gel and transferred onto membranes. Non-specific binding can be blocked by incubation, for example, with 5% non-fat milk for 1 hour followed by primary antibody for 16 hours at 4° C. Following washes, the secondary antibody is applied, for example (1:10,000 dilution) for 1 hour at room temperature and the signal detected on a VersaDoc imaging system In several cell culture systems, cationic lipids have been shown to enhance the bioavailability of oligonucleotides to cells in culture (Bennet, et al., 1992, Mol. Pharmacology, 41, 1023-1033). In one embodiment, dsRNA molecules of the invention are complexed with cationic lipids for cell culture experiments. dsRNA and cationic lipid mixtures are prepared in serum-free OptimMEM (InVitrogen) immediately prior to addition to the cells. OptiMEM is warmed to room temperature (about 20-25° C.) and cationic lipid is added to the final desired concentration. dsRNA molecules are added to OptiMEM to the desired concentration and the solution is added to the diluted dsRNA and incubated for 15 minutes at room temperature. In dose response experiments, the RNA complex is serially diluted into OptiMEM prior to addition of the cationic lipid.

Animal Models

The efficacy of anti-HIF-1α dsRNA agents may be evaluated in an animal model. Animal models of cancer and/or proliferative diseases, conditions, or disorders as are known in the art can be used for evaluation of the efficacy, potency, toxicity, etc. of anti-HIF-1α dsRNAs. Suitable animal models of proliferative disease include, e.g., transgenic rodents (e.g., mice, rats) bearing gain of function proto-oncogenes (e.g., Myc, Src) and/or loss of function of tumour suppressor proteins (e.g., p53, Rb) or rodents that have been exposed to radiation or chemical mutagens that induce DNA changes that facilitate neoplastic transformation. Many such animal models are commercially available, for example, from The Jackson Laboratory, Bar Harbor, Me., USA. These animal models may be used as a source cells or tissue for assays of the compositions of the invention. Such models can also be used or adapted for use for pre-clinical evaluation of the efficacy of dsRNA compositions of the invention in modulating HIF-1α gene expression toward therapeutic use.

As in cell culture models, the most HIF-1α relevant mouse tumor xenografts are those derived from cancer cells that express HIF-1α proteins. Xenograft mouse models of cancer relevant to study of the anti-tumor effect of modulating HIF-1α have been described by various groups (e.g., Welsh et al., Mol Cancer Ther. 2004; 3(3):233-244, "Antitumor activity and pharmacodynamic properties of PX-478, an inhibitor of hypoxia-inducible factor-1α"; Chen et al., Am J Pathol 2003, 162:1283-1291, "Dominant-Negative Hypoxia-Inducible Factor-1a Reduces Tumorigenicity of Pancreatic Cancer Cells through the Suppresion of Glucose Metabolisom"). Use of these models has demonstrated that inhibition of HIF-1α expression by anti-HIF-1α agents causes inhibition of tumor growth in animals.

Such models can be used in evaluating the efficacy of dsRNA molecules of the invention to inhibit HIF-1α levels, expression, tumor/cancer formation, growth, spread, development of other HIF-1α-associated phenotypes, diseases or disorders, etc. These models and others can similarly be used to evaluate the safety/toxicity and efficacy of dsRNA molecules of the invention in a pre-clinical setting.

Specific examples of animal model systems useful for evaluation of the HIF-1α-targeting dsRNAs of the invention include wild-type mice, and orthotopic or subcutaneous Panc-1, MiaPaCa, DU-145, OvCar-3, MCF-7, or SHP-77 tumor model mice. In an exemplary in vivo experiment, dsRNAs of the invention are tail vein injected into such mouse models at doses ranging from 1 to 10 mg/kg or, alternatively, repeated doses are administered at single-dose $IC_{50}$ levels, and organs (e.g., prostate, liver, kidney, lung, pancreas, colon, skin, spleen, bone marrow, lymph nodes, mammary fat pad, etc.) are harvested 24 hours after administration of the final dose. Such organs are then evaluated for mouse and/or human HIF-1α levels, depending upon the model used. Duration of action can also be examined at, e.g., 1, 4, 7, 14, 21 or more days after final dsRNA administration.

The practice of the present invention employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982, Molecular Cloning (Cold Spring Harbor Laboratory Press, Cold Spring Harbor, N.Y.); Sambrook et al., 1989, Molecular Cloning, 2nd Ed. (Cold Spring Harbor Laboratory Press, Cold Spring Harbor, N.Y.); Sambrook and Russell, 2001, Molecular Cloning, 3rd Ed. (Cold Spring Harbor Laboratory Press, Cold Spring Harbor, N.Y.); Ausubel et al., 1992), Current Protocols in Molecular Biology (John Wiley & Sons, including periodic updates); Glover, 1985, DNA Cloning (IRL Press, Oxford); Anand, 1992; Guthrie and Fink, 1991; Harlow and Lane, 1988, Antibodies, (Cold Spring Harbor Laboratory Press, Cold Spring Harbor, N.Y.); Jakoby and Pastan, 1979; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Riott, Essential Immunology, 6th Edition, Blackwell Scientific Publications, Oxford, 1988; Hogan et al., Manipulating the Mouse Embryo, (Cold Spring Harbor Laboratory Press, Cold Spring Harbor, N.Y., 1986); Westerfield, M., The zebrafish book. A guide for the laboratory use of zebrafish (*Danio rerio*), (4th Ed., Univ. of Oregon Press, Eugene, 2000).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

The present invention is described by reference to the following Examples, which are offered by way of illustration and are not intended to limit the invention in any manner. Standard techniques well known in the art or the techniques specifically described below were utilized.

Example 1

Preparation of Double-Stranded RNA Oligonucleotides

Oligonucleotide Synthesis and Purification

DsiRNA molecules can be designed to interact with various sites in the RNA message, for example, target sequences within the RNA sequences described herein. In presently exemplified agents, 378 human target HIF-1α sequences and 72 mouse target HIF-1α sequences were selected for evaluation (258 of the 378 human target HIF-1α sites were predicted to be conserved with corresponding sites in the mouse HIF-1α transcript sequence). The sequences of one strand of the DsiRNA molecules were complementary to the target HIF-1α site sequences described above. The DsiRNA molecules were chemically synthesized using methods described herein. Generally, DsiRNA constructs were synthesized using solid phase oligonucleotide synthesis methods as described for 19-23mer siRNAs (see for example Usman et al., U.S. Pat. Nos. 5,804,683; 5,831,071; 5,998,203; 6,117,657; 6,353,098; 6,362,323; 6,437,117; 6,469,158; Scaringe et al., U.S. Pat. Nos. 6,111,086; 6,008,400; 6,111,086).

Individual RNA strands were synthesized and HPLC purified according to standard methods (Integrated DNA Technologies, Coralville, Iowa). For example, RNA oligonucleotides were synthesized using solid phase phosphoramidite chemistry, deprotected and desalted on NAP-5 columns (Amersham Pharmacia Biotech, Piscataway, N.J.) using standard techniques (Damha and Olgivie, 1993, *Methods Mol Biol* 20: 81-114; Wincott et al., 1995, *Nucleic Acids Res* 23: 2677-84). The oligomers were purified using ion-exchange high performance liquid chromatography (IE-HPLC) on an Amersham Source 15Q column (1.0 cm×25 cm; Amersham Pharmacia Biotech, Piscataway, N.J.) using a 15 min step-linear gradient. The gradient varies from 90:10 Buffers A:B to 52:48 Buffers A:B, where Buffer A is 100 mM Tris pH 8.5 and Buffer B is 100 mM Tris pH 8.5, 1 M NaCl. Samples were monitored at 260 nm and peaks corresponding to the full-length oligonucleotide species are collected, pooled, desalted on NAP-5 columns, and lyophilized.

The purity of each oligomer was determined by capillary electrophoresis (CE) on a Beckman PACE 5000 (Beckman Coulter, Inc., Fullerton, Calif.). The CE capillaries had a 100 µm inner diameter and contains ssDNA 100R Gel (Beckman-Coulter). Typically, about 0.6 nmole of oligonucleotide was injected into a capillary, run in an electric field of 444 V/cm and detected by UV absorbance at 260 nm. Denaturing Tris-Borate-7 M-urea running buffer was purchased from Beckman-Coulter. Oligoribonucleotides were obtained that are at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems, Foster City, Calif.) following the manufacturer's recommended protocol. Relative molecular masses of all oligomers were obtained, often within 0.2% of expected molecular mass.

Preparation of Duplexes

Single-stranded RNA (ssRNA) oligomers were resuspended, e.g., at 100 µM concentration in duplex buffer consisting of 100 mM potassium acetate, 30 mM HEPES, pH 7.5. Complementary sense and antisense strands were mixed in equal molar amounts to yield a final solution of, e.g., 50 µM duplex. Samples were heated to 100° C. for 5' in RNA buffer (IDT) and allowed to cool to room temperature before use. Double-stranded RNA (dsRNA) oligomers were stored at −20° C. Single-stranded RNA oligomers were stored lyophilized or in nuclease-free water at −80° C.

Nomenclature

For consistency, the following nomenclature has been employed in the instant specification. Names given to duplexes indicate the length of the oligomers and the presence or absence of overhangs. A "25/27" is an asymmetric duplex having a 25 base sense strand and a 27 base antisense strand with a 2-base 3'-overhang. A "27/25" is an asymmetric duplex having a 27 base sense strand and a 25 base antisense strand.

Cell Culture and RNA Transfection

HeLa cells were obtained from ATCC and maintained in DMEM (HyClone) supplemented with 10% fetal bovine serum (HyClone) at 37° C. under 5% $CO_2$. HEPA1-6 cells were obtained from ATCC and maintained in DMEM (HyClone) supplemented with 10% fetal bovine serum (HyClone) at 37° C. under 5% $CO_2$. For RNA transfections, cells were transfected with DsiRNAs as indicated at a final concentration of 1 nM, 0.3 nM or 0.1 nM using Lipofectamine™ RNAiMAX (Invitrogen) and following manufacturer's instructions. Briefly, for 0.1 nM transfections, e.g., of Example 8 below, an aliquot of stock solution of each DsiRNA was mixed with Opti-MEM I (Invitrogen) and Lipofectamine™ RNAiMAX to reach a volume of 200 µL. The resulting 200 µL mix was added per well into duplicate individual wells of 24 well plates and incubated for 20 min at RT to allow DsiRNA:Lipofectamine™ RNAiMAX complexes to form. Meanwhile, target cells were trypsinized and resuspended in medium. Finally, 300 µL of the cell suspension were added to each well (final volume 500 µL) and plates were placed into the incubator for 24 hours.

Assessment of HIF-1α Inhibition

HIF-1α target gene knockdown was determined by qRT-PCR, with values normalized to HPRT and SFRS9 housekeeping genes (or, in Example 8 below, to HPRT only), and to transfections with control DsiRNAs and/or mock transfection controls.

RNA Isolation and Analysis

Media was aspirated, and total RNA was extracted using the SV96 kit (Promega). Approximately 100 ng of total RNA was reverse-transcribed using SuperscriptII, Oligo dT, and random hexamers following manufacturer's instructions. Typically, one-sixth of the resulting cDNA was analyzed by qPCR using primers and probes specific for both the HIF-1α gene and for the human genes HPRT-1 and SFRS9. An ABI 7700 was used for the amplification reactions. Each sample was tested in triplicate. Relative Hif-1α RNA levels were normalized to HPRT1 and SFRS9 RNA levels and compared with RNA levels obtained in mock transfection control samples. For Example 8 below, approximately 200 ng of total RNA was reverse-transcribed using Transcriptor First Strand cDNA Synthesis Kit (Roche) and random hexamers following manufacturer's instructions. Typically, on-fifteenth of the resulting cDNA was analyzed by qPCR using primers and probes specific for both the Hif-1α gene and for the human gene HPRT-1. A Bio-Rad CFX96 was used for the amplification reactions. Each sample was tested in duplicate. Relative Hif-1α RNA levels were normalized to HPRT1 RNA levels and compared with RNA levels obtained in mock transfection control samples.

Example 2

DsiRNA Inhibition of HIF-1α—Primary Screen

DsiRNA molecules targeting HIF-1α were designed and synthesized as described above and tested in HeLa cells for inhibitory efficacy. For transfection, annealed DsiRNAs were mixed with the transfection reagent (Lipofectamine™ RNAiMAX, Invitrogen) in a volume of 50 µl/well and incubated for 20 minutes at room temperature. The HeLa (human) or HEPA1-6 (mouse) cells were trypsinized, resuspended in media, and added to wells (100 uL per well) to give a final DsiRNA concentration of 1 nM in a volume of 150 µl. Each DsiRNA transfection mixture was added to 3 wells for triplicate DsiRNA treatments. Cells were incubated at 37° C. for 24 hours in the continued presence of the DsiRNA transfection mixture. At 24 hours, RNA was prepared from each well of treated cells. The supernatants with the transfection mixtures were first removed and discarded, then the cells were lysed and RNA prepared from each well. Target HIF-1α RNA levels following treatment were evaluated by qRT-PCR for the HIF-1α target gene, with values normalized to those obtained for controls. Triplicate data was averaged and the % error determined for each treatment. Normalized data were graphed and the reduction of target mRNA by active DsiRNAs in comparison to controls was determined.

HIF-1α targeting DsiRNAs examined for HIF-1α inhibitory efficacy in a primary phase of testing are indicated in Tables 8 and 9 below. In this example, 450 asymmetric DsiRNAs (tested DsiRNAs possessed a 25/27mer structure) were constructed and tested for HIF-1α inhibitory efficacy in human HeLa and mouse HEPA1-6 cells incubated in the presence of such DsiRNAs at a concentration of 1 nM. The 450 asymmetric DsiRNAs tested included DsiRNAs selected from Tables 2 and 4 above, where sequences and structures of these tested asymmetric DsiRNAs are shown (in above Tables 2 and 4, underlined nucleotide residues indicate 2'-O-methyl modified residues, ribonucleotide residues are shown as UPPER CASE, and deoxyribonucleotide residues are shown as lower case).

Assay of the 450 HIF-1α targeting DsiRNAs in human HeLa and mouse HEPA1-6 cells at 1 nM revealed the following HIF-1α inhibitory efficacies, presented in Tables 8 and 9. HIF-1α levels were determined using qPCR assays positioned at indicated locations within the HIF-1α transcript (for human HeLa cell experiments, paired qPCR assays were performed and are indicated as "Hs HIF-1α 815-1008" (MAX) and "Hs HIF-1α 2690-2866" (FAM); for mouse HEPA1-6 cell experiments, paired qPCR assays were performed and are indicated as "Mm HIF-1α 1055-1223" (MAX) and "Mm HIF-1α 2463-2593" (FAM)).

TABLE 8

HIF-1α Inhibitory Efficacy of DsiRNAs Assayed at 1 nM in Human HeLa Cells

| DsiRNA Name (Human HIF-1α Target Location, Transcript Variant 1) | Human HIF-1α Target Location, Transcript Variant 2 | Mouse HIF-1α Target Location | % Remaining HIF-1α mRNA ± % Error (Assay: Hs HIF-1α 815-1008) | % Remaining HIF-1α mRNA ± % Error (Assay: Hs HIF-1α 2690-2866) |
|---|---|---|---|---|
| HIF-1α-81 | 81 | m103 | 131 ± 7.1 | 114.8 ± 4.1 |
| HIF-1α-83 | 83 | m105 | 119.7 ± 6.3 | 112.2 ± 4 |
| HIF-1α-85 | 85 | m107 | 146.6 ± 13.9 | 168.4 ± 13.6 |
| HIF-1α-87 | 87 | m109 | 103.6 ± 7.2 | 112.2 ± 10.2 |
| HIF-1α-89 | 89 | m111 | 122.8 ± 3.9 | 119.4 ± 2.1 |
| HIF-1α-123 | 123 | N/A | 105.9 ± 11.4 | 103.5 ± 13.5 |
| HIF-1α-124 | 124 | N/A | 101.5 ± 5.4 | 92.4 ± 5.1 |
| HIF-1α-126 | 126 | N/A | 100.4 ± 5.5 | 101 ± 4.1 |
| HIF-1α-130 | 130 | N/A | 96.1 ± N/A | 136.7 ± N/A |
| HIF-1α-131 | 131 | N/A | 113.3 ± 7 | 98.1 ± 4.5 |
| HIF-1α-147 | 147 | N/A | 110.9 ± 3.9 | 135.8 ± 6.2 |
| HIF-1α-265 | 265 | N/A | 99.2 ± 8.8 | 99.9 ± 5.2 |
| HIF-1α-267 | 267 | N/A | 42.7 ± 4.9 | 51.3 ± 6.5 |
| HIF-1α-268 | 268 | N/A | 60.2 ± 8 | 91.8 ± 6.9 |
| HIF-1α-292 | 292 | N/A | 80 ± 6.6 | 101 ± 7.2 |
| HIF-1α-319 | 319 | N/A | 34.4 ± 7 | 34.4 ± 8.1 |
| HIF-1α-322 | 322 | N/A | 53.1 ± 1.9 | 69.9 ± 2 |
| HIF-1α-324 | 324 | N/A | 86.9 ± 3.3 | 54.5 ± 4.5 |
| HIF-1α-327 | 327 | N/A | 111.4 ± 11.5 | 96.9 ± 7.7 |
| HIF-1α-329 | 329 | N/A | 85.1 ± 5.4 | 104.9 ± 13.5 |
| HIF-1α-330 | 330 | N/A | 82.9 ± 5.2 | 75.7 ± 6.3 |
| HIF-1α-331 | 331 | N/A | 103 ± 10.9 | 106.8 ± 12.8 |
| HIF-1α-342 | 342 | N/A | 130.1 ± 4.8 | 132.7 ± 4.1 |
| HIF-1α-344 | 344 | N/A | 117.6 ± 3.1 | 73.8 ± 7 |
| HIF-1α-346 | 346 | N/A | 96.5 ± 8.6 | 92.9 ± 8.9 |
| HIF-1α-359 | 359 | N/A | 54.6 ± 9.8 | 47.6 ± 7 |
| HIF-1α-403 | 403 | N/A | 26.8 ± 4.6 | 29 ± 3.8 |
| HIF-1α-422 | 422 | N/A | 133.7 ± 16.1 | 138.9 ± 16.7 |
| HIF-1α-427 | 427 | m446 | 121 ± 10.5 | 128.3 ± 11.1 |
| HIF-1α-429 | 429 | m448 | 146.2 ± 3.4 | 132.7 ± 10.9 |
| HIF-1α-448 | 448 | N/A | 23.9 ± 14.1 | 31.3 ± 9.9 |
| HIF-1α-455 | 455 | N/A | 47.4 ± 9.1 | 56.2 ± 12 |
| HIF-1α-469 | 469 | m488 | 27 ± 3.8 | 27.3 ± 4.4 |
| HIF-1α-471 | 471 | m490 | 17.1 ± 5.2 | 17.5 ± 3.1 |
| HIF-1α-473 | 473 | m492 | 13.8 ± 10.3 | 16.4 ± 9.6 |
| HIF-1α-475 | 475 | m494 | 10.2 ± 7.3 | 22.2 ± 13.6 |
| HIF-1α-525 | 525 | N/A | 18.1 ± 7.1 | 13.5 ± 12.6 |
| HIF-1α-528 | 528 | m547 | 33 ± 2.6 | 42.1 ± 5.2 |
| HIF-1α-530 | 530 | m549 | 21.1 ± 3.3 | 23.1 ± 3.3 |
| HIF-1α-532 | 532 | m551 | 25.7 ± 5 | 27.7 ± 6.5 |
| HIF-1α-534 | 534 | m553 | 18.4 ± 12.1 | 21.7 ± 6.9 |
| HIF-1α-536 | 536 | m555 | 24.4 ± N/A | 26 ± N/A |
| HIF-1α-538 | 538 | m557 | 49.8 ± 6 | 47.9 ± 5.2 |

TABLE 8-continued

HIF-1α Inhibitory Efficacy of DsiRNAs Assayed at 1 nM in Human HeLa Cells

| DsiRNA Name (Human HIF-1α Target Location, Transcript Variant 1) | Human HIF-1α Target Location, Transcript Variant 2 | Mouse HIF-1α Target Location | % Remaining HIF-1α mRNA ± % Error (Assay: Hs HIF-1α 815-1008) | % Remaining HIF-1α mRNA ± % Error (Assay: Hs HIF-1α 2690-2866) |
|---|---|---|---|---|
| HIF-1α-540 | 540 | m559 | 23.6 ± 2.3 | 25.1 ± 2.4 |
| HIF-1α-542 | 542 | m561 | 17.4 ± 9.9 | 25.4 ± 12.7 |
| HIF-1α-544 | 544 | m563 | 17.2 ± 5.4 | 24.1 ± 3.9 |
| HIF-1α-546 | 546 | m565 | 16.6 ± 8.7 | 20 ± 7 |
| HIF-1α-548 | 548 | m567 | 18.4 ± 8.6 | 20.9 ± 6.3 |
| HIF-1α-550 | 550 | m569 | 18.5 ± 5.6 | 16.9 ± 11.4 |
| HIF-1α-562 | 562 | N/A | 14.3 ± 9.6 | 16.9 ± 4.8 |
| HIF-1α-642 | 642 | N/A | 13.2 ± 10.1 | 14.3 ± 9.9 |
| HIF-1α-644 | 644 | N/A | 19.3 ± 9.7 | 19.7 ± 4.8 |
| HIF-1α-645 | 645 | N/A | 25.7 ± 15.1 | 45.2 ± 5.4 |
| HIF-1α-665 | 665 | N/A | 43.8 ± 15 | 29.9 ± 5.7 |
| HIF-1α-691 | 691 | N/A | 15 ± 6.9 | 14.8 ± 6.6 |
| HIF-1α-707 | 707 | N/A | 13.3 ± 12.6 | 13.2 ± 19.7 |
| HIF-1α-711 | 711 | N/A | 9 ± 7.6 | 9.7 ± 13.4 |
| HIF-1α-713 | 713 | N/A | 10.7 ± 6.5 | 13 ± 7 |
| HIF-1α-715 | 715 | N/A | 7.3 ± 10.8 | 15.4 ± 16.2 |
| HIF-1α-717 | 717 | N/A | 10.5 ± 12 | 13.8 ± 14.6 |
| HIF-1α-756 | 756 | N/A | 15.2 ± 9.2 | 14.6 ± 8.4 |
| HIF-1α-790 | 790 | N/A | 10.8 ± 5.9 | 11.9 ± 4.2 |
| HIF-1α-793 | 793 | m812 | 12.8 ± 7.6 | 14.5 ± 6.8 |
| HIF-1α-824 | 824 | m843 | 14.3 ± 8 | 15.6 ± 6 |
| HIF-1α-826 | 826 | m845 | 51.6 ± 6.5 | 56.1 ± 6.5 |
| HIF-1α-828 | 828 | m847 | 18.6 ± 17.9 | 34.4 ± 7.8 |
| HIF-1α-830 | 830 | m849 | 64.2 ± 8.9 | 82 ± 11.2 |
| HIF-1α-832 | 832 | m851 | 33.2 ± 8.4 | 40.7 ± 4.1 |
| HIF-1α-834 | 834 | m853 | 16 ± 5.4 | 22.4 ± 2.5 |
| HIF-1α-836 | 836 | m855 | 58.4 ± 10.1 | 38.5 ± 16.5 |
| HIF-1α-838 | 838 | m857 | 16 ± 7.6 | 17.9 ± 3.6 |
| HIF-1α-840 | 840 | m859 | 18.1 ± 3.4 | 21.8 ± 4.3 |
| HIF-1α-842 | 842 | m861 | 17.5 ± 3.1 | 20.7 ± 3.9 |
| HIF-1α-844 | 844 | m863 | 9.3 ± 18.2 | 24.1 ± 19.2 |
| HIF-1α-846 | 846 | m865 | 15 ± 1.1 | 19.9 ± 5.5 |
| HIF-1α-848 | 848 | m867 | 13.8 ± 4.2 | 19.9 ± 9.8 |
| HIF-1α-850 | 850 | m869 | 9.7 ± 3.9 | 13.7 ± 2.6 |
| HIF-1α-852 | 852 | m871 | 14.2 ± 4.3 | 14.5 ± 2.3 |
| HIF-1α-921 | 921 | N/A | 7 ± 16.7 | 15 ± 11 |
| HIF-1α-925 | 925 | m944 | 8.9 ± 7.6 | 11.9 ± 5.5 |
| HIF-1α-927 | 927 | m946 | 62.5 ± 3.5 | 62.8 ± 2.3 |
| HIF-1α-1029 | 1029 | m1048 | 41.1 ± 8.4 | 42.8 ± 7.4 |
| HIF-1α-1031 | 1031 | m1050 | 29.1 ± 4.6 | 45.8 ± 4.4 |
| HIF-1α-1033 | 1033 | m1052 | 28.7 ± 18.9 | 39.5 ± 15.4 |
| HIF-1α-1035 | 1035 | m1054 | 7.9 ± 5.8 | 13.9 ± 4 |
| HIF-1α-1037 | 1037 | m1056 | 30.4 ± 3.3 | 33.6 ± 4 |
| HIF-1α-1039 | 1039 | m1058 | 45.6 ± 13.2 | 48.5 ± 16.4 |
| HIF-1α-1041 | 1041 | m1060 | 12.7 ± 9.8 | 15.4 ± 7.5 |
| HIF-1α-1043 | 1043 | m1062 | 54.4 ± 2.5 | 54.5 ± 3.1 |
| HIF-1α-1045 | 1045 | m1064 | 40.2 ± 4.5 | 46.5 ± 2.4 |
| HIF-1α-1074 | 1074 | N/A | 18 ± 9.5 | 13.6 ± 11.9 |
| HIF-1α-1075 | 1075 | N/A | 17.6 ± 17.3 | 35 ± 13.3 |
| HIF-1α-1077 | 1077 | N/A | 10.8 ± 12.4 | 9.7 ± 9.2 |
| HIF-1α-1084 | 1084 | m1103 | 6 ± 16.9 | 13.4 ± 7.9 |
| HIF-1α-1086 | 1086 | m1105 | 33.7 ± 16.4 | 43.1 ± 18.5 |
| HIF-1α-1088 | 1088 | m1107 | 10.5 ± 7 | 13.1 ± 6.2 |
| HIF-1α-1090 | 1090 | m1109 | 5.7 ± 7.3 | 10 ± 5 |
| HIF-1α-1092 | 1092 | m1111 | N/A ± N/A | N/A ± N/A |
| HIF-1α-1094 | 1094 | m1113 | 11.7 ± 1.2 | 18 ± 4.9 |
| HIF-1α-1096 | 1096 | m1115 | 17.9 ± 6.7 | 20.8 ± 7.1 |
| HIF-1α-1120 | 1120 | m1139 | 12.9 ± 20.6 | 15.8 ± 10.7 |
| HIF-1α-1122 | 1122 | m1141 | 6 ± 15.3 | 21.5 ± 9.3 |
| HIF-1α-1124 | 1124 | m1143 | 29.2 ± 6.7 | 35.2 ± 4 |
| HIF-1α-1126 | 1126 | m1145 | 67.6 ± 5 | 59 ± 5.7 |
| HIF-1α-1128 | 1128 | m1147 | 7.1 ± 9 | 10.5 ± 8 |
| HIF-1α-1130 | 1130 | m1149 | 15.3 ± 0.8 | 15.4 ± 3.3 |
| HIF-1α-1132 | 1132 | m1151 | 26.7 ± 2.7 | 27.2 ± 2.2 |
| HIF-1α-1166 | 1166 | N/A | 13.1 ± 6.1 | 13.8 ± 4.5 |
| HIF-1α-1174 | 1174 | N/A | 30.4 ± 9.3 | 40.3 ± 10.1 |
| HIF-1α-1243 | 1243 | m1262 | 6.8 ± 3.8 | 8 ± 2.7 |
| HIF-1α-1245 | 1245 | m1264 | 11.9 ± 20.1 | 13.8 ± 16.2 |
| HIF-1α-1247 | 1247 | m1266 | 9.3 ± 10.7 | 16.4 ± 12.3 |
| HIF-1α-1249 | 1249 | m1268 | 15.3 ± 9.2 | 18.1 ± 9.6 |
| HIF-1α-1251 | 1251 | m1270 | 67.3 ± 7.7 | 57.6 ± 8.9 |
| HIF-1α-1253 | 1253 | m1272 | 39.3 ± 6.5 | 39.5 ± 4.9 |

TABLE 8-continued

HIF-1α Inhibitory Efficacy of DsiRNAs Assayed at 1 nM in Human HeLa Cells

| DsiRNA Name (Human HIF-1α Target Location, Transcript Variant 1) | Human HIF-1α Target Location, Transcript Variant 2 | Mouse HIF-1α Target Location | % Remaining HIF-1α mRNA ± % Error (Assay: Hs HIF-1α 815-1008) | % Remaining HIF-1α mRNA ± % Error (Assay: Hs HIF-1α 2690-2866) |
|---|---|---|---|---|
| HIF-1α-1255 | 1255 | m1274 | 41.5 ± 1.5 | 40.8 ± 9.1 |
| HIF-1α-1257 | 1257 | m1276 | 31.8 ± 3 | 31.8 ± 3.2 |
| HIF-1α-1262 | 1262 | N/A | 15.1 ± 7.9 | 15.2 ± 7.9 |
| HIF-1α-1265 | 1265 | N/A | 17.8 ± 10.3 | 18.7 ± 17.8 |
| HIF-1α-1268 | 1268 | N/A | 24.4 ± 6.1 | 25.9 ± 3.6 |
| HIF-1α-1271 | 1271 | N/A | 16.2 ± 6.4 | 18.7 ± 8.8 |
| HIF-1α-1278 | 1278 | m1297 | 28.5 ± 3.6 | 23.7 ± 2 |
| HIF-1α-1280 | 1280 | m1299 | 16.3 ± 11.3 | 15.2 ± 10.3 |
| HIF-1α-1282 | 1282 | m1301 | 8.9 ± 16.5 | 16.5 ± 15.9 |
| HIF-1α-1303 | 1303 | m1322 | 5.1 ± 13.3 | 8 ± 8.5 |
| HIF-1α-1305 | 1305 | m1324 | 8.7 ± 15.6 | 12 ± 10.3 |
| HIF-1α-1307 | 1307 | m1326 | 33.7 ± 5.6 | 32.8 ± 2.3 |
| HIF-1α-1309 | 1309 | m1328 | 52 ± 24 | 42.7 ± 24.9 |
| HIF-1α-1311 | 1311 | m1330 | 48 ± 3.3 | 40.9 ± 4.7 |
| HIF-1α-1313 | 1313 | m1332 | 35.9 ± 12.7 | 31.4 ± 8.2 |
| HIF-1α-1315 | 1315 | m1334 | 6.9 ± 7.2 | 13.2 ± 4.1 |
| HIF-1α-1317 | 1317 | m1336 | 29.3 ± 12.7 | 57.8 ± 11.9 |
| HIF-1α-1319 | 1319 | m1338 | 21.9 ± 10.1 | 20 ± 25.7 |
| HIF-1α-1321 | 1321 | m1340 | 28 ± 6.6 | 26.3 ± 10.7 |
| HIF-1α-1323 | 1323 | m1342 | 30.2 ± 8.1 | 26.9 ± 8 |
| HIF-1α-1325 | 1325 | m1344 | 16.1 ± 11 | 25.1 ± 9 |
| HIF-1α-1327 | 1327 | m1346 | 56.4 ± 5.8 | 44.2 ± 4.3 |
| HIF-1α-1329 | 1329 | m1348 | 4.3 ± 20.5 | 8.4 ± 8.9 |
| HIF-1α-1331 | 1331 | m1350 | 30.9 ± 8.8 | 25.8 ± 11.3 |
| HIF-1α-1333 | 1333 | m1352 | 12.1 ± 4.3 | 21.6 ± 13 |
| HIF-1α-1335 | 1335 | m1354 | 11.2 ± 14.5 | 14.3 ± 17.9 |
| HIF-1α-1337 | 1337 | m1356 | 9.6 ± 4.1 | 9.5 ± 3.3 |
| HIF-1α-1339 | 1339 | m1358 | 11.8 ± 5.9 | 11 ± 5.1 |
| HIF-1α-1341 | 1341 | m1360 | 31.7 ± 8.3 | 23.9 ± 6.3 |
| HIF-1α-1343 | 1343 | m1362 | 19.8 ± 4.7 | 18.8 ± 2.8 |
| HIF-1α-1345 | 1345 | m1364 | 10.7 ± 17.7 | 12.4 ± 8.3 |
| HIF-1α-1347 | 1347 | m1366 | 29.4 ± 11 | 31.4 ± 7.7 |
| HIF-1α-1349 | 1349 | m1368 | 7.1 ± 12.4 | 14.4 ± 9.6 |
| HIF-1α-1351 | 1351 | m1370 | 13.8 ± 10 | 16.2 ± 5.6 |
| HIF-1α-1353 | 1353 | m1372 | 16.6 ± 7.3 | 24.4 ± 8.4 |
| HIF-1α-1355 | 1355 | m1374 | 5.5 ± 7.3 | 6.9 ± 6.9 |
| HIF-1α-1357 | 1357 | m1376 | 13 ± 11.6 | 18.1 ± 16.5 |
| HIF-1α-1359 | 1359 | m1378 | 9 ± 4.6 | 10.3 ± 4 |
| HIF-1α-1361 | 1361 | m1380 | 12.1 ± 20.2 | 13.7 ± 13.5 |
| HIF-1α-1363 | 1363 | m1382 | 5.1 ± 7.3 | 6.5 ± 3.9 |
| HIF-1α-1365 | 1365 | m1384 | 7.8 ± 7.1 | 17.7 ± 13.9 |
| HIF-1α-1367 | 1367 | m1386 | 20.2 ± 10.3 | 23.5 ± 10.3 |
| HIF-1α-1369 | 1369 | m1388 | 7.7 ± 8.6 | 10.2 ± 24.3 |
| HIF-1α-1371 | 1371 | m1390 | 17.7 ± 4.5 | 18.2 ± 6.4 |
| HIF-1α-1373 | 1373 | m1392 | 6.4 ± 5.9 | 10.4 ± 3.4 |
| HIF-1α-1375 | 1375 | m1394 | 6.2 ± 3.6 | 7.8 ± 1.1 |
| HIF-1α-1377 | 1377 | m1396 | 16.9 ± 5.2 | 18 ± 4.2 |
| HIF-1α-1379 | 1379 | m1398 | 6.8 ± 4.5 | 9.9 ± 6 |
| HIF-1α-1381 | 1381 | m1400 | 5.5 ± 16.7 | 10.7 ± 12.1 |
| HIF-1α-1383 | 1383 | m1402 | 13.6 ± 11.4 | 14.6 ± 11.9 |
| HIF-1α-1385 | 1385 | m1404 | 4.3 ± 5.5 | 7.5 ± 3.5 |
| HIF-1α-1387 | 1387 | m1406 | 10.1 ± 7.4 | 12 ± 7.2 |
| HIF-1α-1456 | 1456 | m1475 | 5.7 ± 13.8 | 9.1 ± 21.2 |
| HIF-1α-1458 | 1458 | m1477 | 5.3 ± 7.3 | 6.7 ± 6.1 |
| HIF-1α-1460 | 1460 | m1479 | 17.3 ± 4.9 | 18.9 ± 5.8 |
| HIF-1α-1462 | 1462 | m1481 | 6.4 ± 2.3 | 7.9 ± 7.3 |
| HIF-1α-1464 | 1464 | m1483 | 24 ± 19.3 | 29.8 ± 4.2 |
| HIF-1α-1466 | 1466 | m1485 | 11.3 ± 18.5 | 17 ± 19.1 |
| HIF-1α-1468 | 1468 | m1487 | 9.2 ± 15.6 | 7.6 ± 8.1 |
| HIF-1α-1470 | 1470 | m1489 | 7 ± 6.3 | 9.2 ± 7.6 |
| HIF-1α-1472 | 1472 | m1491 | 6.8 ± 19.7 | 26.2 ± 31.9 |
| HIF-1α-1474 | 1474 | m1493 | 7.4 ± 4.4 | 12.5 ± 6.6 |
| HIF-1α-1476 | 1476 | m1495 | 13.1 ± 11.9 | 15.1 ± 9.7 |
| HIF-1α-1478 | 1478 | m1497 | 5 ± 9.5 | 6.8 ± 3.3 |
| HIF-1α-1480 | 1480 | m1499 | 24 ± 21.6 | 32.1 ± 24.7 |
| HIF-1α-1482 | 1482 | m1501 | 18.2 ± 6.6 | 28 ± 6.3 |
| HIF-1α-1519 | 1519 | m1538 | 7.2 ± 12.4 | 5.4 ± 6.8 |
| HIF-1α-1552 | 1552 | m1571 | 10.8 ± 3.9 | 12.6 ± 4.8 |
| HIF-1α-1572 | 1572 | N/A | 10 ± 1.3 | 11.2 ± 3.1 |
| HIF-1α-1648 | 1648 | N/A | 16.6 ± 11.4 | 16.3 ± 10.5 |
| HIF-1α-1709 | 1709 | N/A | 26.7 ± 5.1 | 30.3 ± 6.2 |
| HIF-1α-1714 | 1714 | m1733 | 15.8 ± 4.6 | 28.3 ± 4.1 |

TABLE 8-continued

HIF-1α Inhibitory Efficacy of DsiRNAs Assayed at 1 nM in Human HeLa Cells

| DsiRNA Name (Human HIF-1α Target Location, Transcript Variant 1) | Human HIF-1α Target Location, Transcript Variant 2 | Mouse HIF-1α Target Location | % Remaining HIF-1α mRNA ± % Error (Assay: Hs HIF-1α 815-1008) | % Remaining HIF-1α mRNA ± % Error (Assay: Hs HIF-1α 2690-2866) |
|---|---|---|---|---|
| HIF-1α-1786 | 1786 | N/A | 47.3 ± 5.3 | 48.7 ± 1.9 |
| HIF-1α-1804 | 1804 | m1820 | 10.2 ± 5.2 | 11.6 ± 5.7 |
| HIF-1α-1806 | 1806 | m1822 | 46.6 ± 6.8 | 46.5 ± 7.6 |
| HIF-1α-1808 | 1808 | m1824 | 29.7 ± 6.3 | 32.4 ± 4.6 |
| HIF-1α-1810 | 1810 | m1826 | 35.2 ± 30.1 | 46.2 ± 13.4 |
| HIF-1α-1814 | 1814 | N/A | 70.4 ± 1.5 | 77.3 ± 3.2 |
| HIF-1α-1845 | 1845 | N/A | 14.6 ± 8.6 | 12.3 ± 7.5 |
| HIF-1α-1936 | 1936 | m1952 | 20.2 ± 17.2 | 30 ± 13.4 |
| HIF-1α-1938 | 1938 | m1954 | 16.9 ± 5.3 | 10.6 ± 3.9 |
| HIF-1α-1940 | 1940 | m1956 | 23.6 ± 7.7 | 26.6 ± 8.1 |
| HIF-1α-1942 | 1942 | m1958 | 46.5 ± 6.8 | 60.8 ± 15.8 |
| HIF-1α-1944 | 1944 | m1960 | 19.3 ± 3.2 | 22.7 ± 4.2 |
| HIF-1α-1946 | 1946 | m1962 | 15.3 ± 8.1 | 17.9 ± 6.1 |
| HIF-1α-1977 | 1977 | N/A | 22.3 ± 2.6 | 22 ± 3.3 |
| HIF-1α-1985 | 1985 | N/A | 14.2 ± 23.2 | 8 ± 6.5 |
| HIF-1α-2034 | 2034 | N/A | 10.3 ± 6.7 | 9.9 ± 6.7 |
| HIF-1α-2116 | 2116 | m2174 | 14 ± 3.8 | 16.4 ± 4.6 |
| HIF-1α-2118 | 2118 | m2176 | 10.4 ± 10.7 | 9.8 ± 10.6 |
| HIF-1α-2120 | 2120 | m2178 | 10.8 ± 10.5 | 15 ± 4.3 |
| HIF-1α-2122 | 2122 | m2180 | 28.5 ± 11.3 | 23.2 ± 5.5 |
| HIF-1α-2161 | 2161 | m2219 | 10.8 ± 7.6 | 15.9 ± 4.1 |
| HIF-1α-2185 | 2185 | N/A | 42 ± 6.5 | 48.8 ± 8.4 |
| HIF-1α-2187 | 2187 | N/A | 17.5 ± 2.9 | 32.2 ± 8.7 |
| HIF-1α-2290 | 2290 | N/A | 9.8 ± 3.8 | 9.6 ± 5.5 |
| HIF-1α-2326 | 2326 | N/A | 20.5 ± 4.6 | 25.2 ± 4 |
| HIF-1α-2452 | 2452 | m2504 | 9.4 ± 8.6 | 24.8 ± 42.5 |
| HIF-1α-2555 | 2555 | N/A | 10.6 ± 1.9 | 11 ± 5.5 |
| HIF-1α-2577 | 2577 | N/A | 12 ± 9.7 | 12.3 ± 7.5 |
| HIF-1α-2584 | 2584 | m2633 | 17.6 ± 5.8 | 23.4 ± 4.8 |
| HIF-1α-2586 | 2586 | m2635 | 18.8 ± 10.4 | 24.8 ± 8.9 |
| HIF-1α-2618 | N/A | N/A | 15.7 ± 3.6 | 9.2 ± 5.7 |
| HIF-1α-2705 | N/A | m2754 | 19.9 ± 5.6 | 12.6 ± 4.8 |
| HIF-1α-2730 | N/A | N/A | 17.1 ± 5.4 | 11.3 ± 7.2 |
| HIF-1α-2796 | 2669 | m2845 | 10.6 ± 3.7 | 10 ± 7.5 |
| HIF-1α-2798 | 2671 | m2847 | 12.6 ± 9.7 | 8.4 ± 2.6 |
| HIF-1α-2800 | 2673 | m2849 | 14.7 ± 4.2 | 16.2 ± 4.3 |
| HIF-1α-2802 | 2675 | m2851 | 13 ± 10.9 | 10.2 ± 8.3 |
| HIF-1α-2823 | 2696 | m2872 | 33.5 ± 6.8 | 39.5 ± 3.7 |
| HIF-1α-2844 | 2717 | m2893 | 19.5 ± 11.7 | 33.4 ± 4.5 |
| HIF-1α-2846 | 2719 | m2895 | 35 ± 2.1 | 40.9 ± 3.9 |
| HIF-1α-2848 | 2721 | m2897 | 33.5 ± 6.1 | 38.9 ± 4.1 |
| HIF-1α-2850 | 2723 | m2899 | 29 ± 15.2 | 33.3 ± 11.3 |
| HIF-1α-2852 | 2725 | m2901 | 10.5 ± 14.2 | 7.7 ± 6.7 |
| HIF-1α-2854 | 2727 | m2903 | 28.5 ± 3.6 | 32 ± 5 |
| HIF-1α-2856 | 2729 | m2905 | 10.3 ± 2.6 | 6.2 ± 7.8 |
| HIF-1α-2858 | 2731 | m2907 | 15.2 ± 8.7 | 14.8 ± 6.8 |
| HIF-1α-2860 | 2733 | m2909 | 11.7 ± 5.4 | 16.4 ± 18.5 |
| HIF-1α-2862 | 2735 | m2911 | 9.2 ± 2.5 | 7.8 ± 5.6 |
| HIF-1α-2864 | 2737 | m2913 | 9.2 ± 5.7 | 6.1 ± 10.7 |
| HIF-1α-2866 | 2739 | m2915 | 20.8 ± 7.4 | 19.2 ± 6.7 |
| HIF-1α-2868 | 2741 | m2917 | 12 ± 8.9 | 13.4 ± 1.5 |
| HIF-1α-2870 | 2743 | m2919 | 10.8 ± 14.2 | 9.4 ± 12.5 |
| HIF-1α-2872 | 2745 | m2921 | 18.1 ± 5.6 | 17.6 ± 4.6 |
| HIF-1α-2874 | 2747 | m2923 | 9.1 ± 4.5 | 8.9 ± 4.7 |
| HIF-1α-2876 | 2749 | m2925 | 11.5 ± 7.6 | 14.2 ± 29.1 |
| HIF-1α-2878 | 2751 | m2927 | 9.8 ± 7.2 | 6.7 ± 3.6 |
| HIF-1α-2880 | 2753 | m2929 | 6.9 ± 12.3 | 4.2 ± 14.8 |
| HIF-1α-2882 | 2755 | m2931 | 9.7 ± 3.9 | 8.3 ± 7.2 |
| HIF-1α-2884 | 2757 | m2933 | 11.7 ± 9 | 12 ± 9 |
| HIF-1α-2886 | 2759 | m2935 | 7.1 ± 6.4 | 5.5 ± 8.1 |
| HIF-1α-2888 | 2761 | m2937 | 35 ± 3.5 | 40.4 ± 4.6 |
| HIF-1α-2890 | 2763 | m2939 | 11.2 ± 9.1 | 12.5 ± 9.4 |
| HIF-1α-2892 | 2765 | m2941 | 12.4 ± 5.8 | 17.6 ± 4.5 |
| HIF-1α-2895 | 2768 | N/A | 7.6 ± 17.3 | 6 ± 17.3 |
| HIF-1α-2906 | 2779 | N/A | 13.8 ± 6.3 | 12.1 ± 6.1 |
| HIF-1α-2910 | 2783 | N/A | 10.7 ± 17.4 | 8.5 ± 19.9 |
| HIF-1α-2919 | 2792 | N/A | 74 ± 5 | 66.6 ± 13.2 |
| HIF-1α-2925 | 2798 | N/A | 14.7 ± 22.2 | 13.6 ± 9.9 |
| HIF-1α-2933 | 2806 | m3042 | 15.7 ± 5 | 14 ± 2.5 |
| HIF-1α-2935 | 2808 | m3044 | 17.2 ± 3.5 | 14.6 ± 4.8 |
| HIF-1α-2963 | 2836 | m3063 | 16.2 ± 5.7 | 11.7 ± 3.8 |
| HIF-1α-2965 | 2838 | m3065 | 16.5 ± 8.3 | 14.8 ± 6.8 |

TABLE 8-continued

HIF-1α Inhibitory Efficacy of DsiRNAs Assayed at 1 nM in Human HeLa Cells

| DsiRNA Name (Human HIF-1α Target Location, Transcript Variant 1) | Human HIF-1α Target Location, Transcript Variant 2 | Mouse HIF-1α Target Location | % Remaining HIF-1α mRNA ± % Error (Assay: Hs HIF-1α 815-1008) | % Remaining HIF-1α mRNA ± % Error (Assay: Hs HIF-1α 2690-2866) |
|---|---|---|---|---|
| HIF-1α-2970 | 2843 | N/A | 13.8 ± 4.3 | 9.7 ± 3.3 |
| HIF-1α-2986 | 2859 | m3086 | 33.3 ± 7.2 | 32.7 ± 9.2 |
| HIF-1α-2988 | 2861 | m3088 | 19.5 ± 7.3 | 14.1 ± 3.4 |
| HIF-1α-2990 | 2863 | m3090 | 25.3 ± 6.5 | 23.8 ± 8.5 |
| HIF-1α-2992 | 2865 | m3092 | 25.9 ± 1.2 | 26.8 ± 12.8 |
| HIF-1α-2994 | 2867 | m3094 | 35.2 ± 5.2 | 30.2 ± 6.5 |
| HIF-1α-2996 | 2869 | m3096 | 35.3 ± 4.8 | 16.8 ± 3.1 |
| HIF-1α-2998 | 2871 | m3098 | 23.6 ± N/A | 13.3 ± N/A |
| HIF-1α-3000 | 2873 | m3100 | 35 ± 23.6 | 24 ± 8.3 |
| HIF-1α-3002 | 2875 | m3102 | 34.6 ± 7.1 | 24.7 ± 7.4 |
| HIF-1α-3004 | 2877 | m3104 | 23.5 ± 4.1 | 22.4 ± 4.2 |
| HIF-1α-3055 | 2928 | N/A | 24.4 ± 3.3 | 21.2 ± 8 |
| HIF-1α-3065 | 2938 | N/A | 16.4 ± 6 | 15.2 ± 7.6 |
| HIF-1α-3067 | 2940 | N/A | 14.9 ± 8.2 | 13 ± 5.8 |
| HIF-1α-3068 | 2941 | N/A | 19.8 ± 2.8 | 15.3 ± 2.9 |
| HIF-1α-3077 | 2950 | N/A | 37 ± 3.9 | 31.1 ± 10.6 |
| HIF-1α-3081 | 2954 | N/A | 27.5 ± 7.3 | 23.8 ± 9.3 |
| HIF-1α-3088 | 2961 | N/A | 22.6 ± 10.5 | 18.6 ± 7.7 |
| HIF-1α-3093 | 2966 | N/A | 35.2 ± 7.7 | 23.6 ± 9.4 |
| HIF-1α-3110 | 2983 | N/A | 21.1 ± 8.3 | 16.9 ± 8.3 |
| HIF-1α-3167 | 3040 | m3257 | 17.6 ± 5.4 | 13.3 ± 7.6 |
| HIF-1α-3169 | 3042 | m3259 | 17.2 ± 19 | 15.3 ± 2.9 |
| HIF-1α-3171 | 3044 | m3261 | 15.1 ± 3.6 | 10.1 ± 4.9 |
| HIF-1α-3173 | 3046 | m3263 | 24.6 ± 4.8 | 20.1 ± 4 |
| HIF-1α-3175 | 3048 | m3265 | 30 ± 5.4 | 27.1 ± 5.9 |
| HIF-1α-3177 | 3050 | m3267 | 43.5 ± 5.8 | 50.6 ± 8.8 |
| HIF-1α-3179 | 3052 | m3269 | 108.2 ± 9.6 | 142.4 ± 9.3 |
| HIF-1α-3215 | 3088 | N/A | 28.8 ± 12.7 | 30.7 ± 12 |
| HIF-1α-3241 | 3114 | N/A | 24.1 ± 8.2 | 19.8 ± 3.8 |
| HIF-1α-3274 | 3147 | m3362 | 25.8 ± 3.3 | 24.7 ± 5.9 |
| HIF-1α-3276 | 3149 | m3364 | 24.8 ± 3 | 23.6 ± 2.6 |
| HIF-1α-3278 | 3151 | m3366 | 21.8 ± 6.5 | 19.6 ± 13.5 |
| HIF-1α-3280 | 3153 | m3368 | 24.6 ± 10.1 | 18.6 ± 7 |
| HIF-1α-3292 | 3165 | N/A | 35.3 ± 7.4 | 38.2 ± 17.1 |
| HIF-1α-3310 | 3183 | N/A | 18.5 ± 7.7 | 14.8 ± 8.1 |
| HIF-1α-3358 | 3231 | m3444 | 23.8 ± 9.8 | 11.8 ± 10 |
| HIF-1α-3360 | 3233 | m3446 | 26.7 ± 11.8 | 19.1 ± 9.1 |
| HIF-1α-3362 | 3235 | m3448 | 15.7 ± 25.1 | 15.6 ± 14.2 |
| HIF-1α-3364 | 3237 | m3450 | 25.5 ± 7.7 | 21 ± 6.9 |
| HIF-1α-3366 | 3239 | m3452 | 24 ± 8.1 | 21.9 ± 5.5 |
| HIF-1α-3368 | 3241 | m3454 | 25 ± 7.1 | 19.5 ± 10.7 |
| HIF-1α-3374 | 3247 | N/A | 27.6 ± 9.1 | 28.1 ± 15.5 |
| HIF-1α-3425 | 3298 | N/A | 18.9 ± 18.7 | 32.8 ± 9.2 |
| HIF-1α-3426 | 3299 | m3511 | 17.4 ± 10.3 | 16.6 ± 13.5 |
| HIF-1α-3428 | 3301 | m3513 | 28 ± 2.5 | 24.8 ± 3.2 |
| HIF-1α-3430 | 3303 | m3515 | 20 ± 2.7 | 16.2 ± 4.2 |
| HIF-1α-3442 | 3315 | N/A | 22.4 ± 5.8 | 20.3 ± 3 |
| HIF-1α-3448 | 3321 | m3530 | 21.2 ± 3 | 16.4 ± 3.1 |
| HIF-1α-3450 | 3323 | m3532 | 20.3 ± 2.7 | 17.4 ± 4.3 |
| HIF-1α-3465 | 3338 | N/A | 23.2 ± 11.5 | 23 ± 3.8 |
| HIF-1α-3493 | 3366 | N/A | 26.9 ± 3.6 | 26.3 ± 4.7 |
| HIF-1α-3529 | 3402 | N/A | 28.9 ± 6.8 | 23 ± 5.6 |
| HIF-1α-3546 | 3419 | m3620 | 15.7 ± 12.3 | 11.8 ± 11.3 |
| HIF-1α-3557 | 3430 | N/A | 39.3 ± 3.2 | 33 ± 4.3 |
| HIF-1α-3592 | 3465 | m3666 | 24.5 ± 12.6 | 21.1 ± 8 |
| HIF-1α-3594 | 3467 | m3668 | 21.9 ± 2.2 | 19.7 ± 1.8 |
| HIF-1α-3596 | 3469 | m3670 | 13 ± 16.5 | 22 ± 6.5 |
| HIF-1α-3598 | 3471 | m3672 | 15.3 ± 9.2 | 12.4 ± 9 |
| HIF-1α-3600 | 3473 | m3674 | 9.8 ± 2.1 | 7.3 ± 4.3 |
| HIF-1α-3602 | 3475 | m3676 | 12.4 ± 7.4 | 10.9 ± 8.6 |
| HIF-1α-3604 | 3477 | m3678 | 23.4 ± 10.4 | 22 ± 8 |
| HIF-1α-3606 | 3479 | m3680 | 11.6 ± 8.2 | 9.6 ± 7.8 |
| HIF-1α-3608 | 3481 | m3682 | 14.9 ± 9.8 | 15.9 ± 8.2 |
| HIF-1α-3608 | 3481 | m3682 | 19.4 ± 12.3 | 15.1 ± 12 |
| HIF-1α-3610 | 3483 | m3684 | 14.9 ± 1 | 14 ± 2.5 |
| HIF-1α-3612 | 3485 | m3686 | 13.5 ± 1.8 | 15.8 ± 15 |
| HIF-1α-3614 | 3487 | m3688 | 32 ± 6.9 | 27.2 ± 6.4 |
| HIF-1α-3616 | 3489 | m3690 | 18.4 ± 4.5 | 15.5 ± 5.6 |
| HIF-1α-3640 | 3513 | N/A | 19 ± 3.4 | 16.2 ± 4.1 |
| HIF-1α-3646 | 3519 | N/A | 18.3 ± 9.2 | 17.1 ± 8.3 |
| HIF-1α-3651 | 3524 | N/A | 24.4 ± 10 | 21.7 ± 10.4 |
| HIF-1α-3670 | 3543 | N/A | 19 ± 13.2 | 16.1 ± 8.2 |

TABLE 8-continued

HIF-1α Inhibitory Efficacy of DsiRNAs Assayed at 1 nM in Human HeLa Cells

| DsiRNA Name (Human HIF-1α Target Location, Transcript Variant 1) | Human HIF-1α Target Location, Transcript Variant 2 | Mouse HIF-1α Target Location | % Remaining HIF-1α mRNA ± % Error (Assay: Hs HIF-1α 815-1008) | % Remaining HIF-1α mRNA ± % Error (Assay: Hs HIF-1α 2690-2866) |
|---|---|---|---|---|
| HIF-1α-3743 | 3616 | N/A | 21.3 ± 13.3 | 16.3 ± 8.4 |
| HIF-1α-3745 | 3618 | N/A | 24.1 ± 6.3 | 16.5 ± 4.1 |
| HIF-1α-3746 | 3619 | N/A | 32.3 ± 5 | 24.9 ± 13.5 |
| HIF-1α-3748 | 3621 | N/A | 31.2 ± 11.5 | 26.4 ± 9.4 |
| HIF-1α-3749 | 3622 | N/A | 36.7 ± 8.2 | 33.6 ± 9.3 |
| HIF-1α-3754 | 3627 | N/A | 21.5 ± 13.1 | 15.5 ± 12.1 |
| HIF-1α-3757 | 3630 | N/A | 28.7 ± 6 | 30.3 ± 6.6 |
| HIF-1α-3791 | 3664 | N/A | 20 ± 4.9 | 25.1 ± 14.7 |
| HIF-1α-3830 | 3703 | N/A | 19.7 ± 4.3 | 19.1 ± 5.5 |
| HIF-1α-3861 | 3734 | m3927 | 14.8 ± 4.2 | 12.4 ± 2.7 |
| HIF-1α-3863 | 3736 | m3929 | 20.6 ± 4.1 | 20 ± 4.2 |
| HIF-1α-3865 | 3738 | m3931 | 13.7 ± 14.8 | 11.9 ± 12 |
| HIF-1α-3867 | 3740 | m3933 | 13.8 ± 10.2 | 13.3 ± 9.4 |
| HIF-1α-3869 | 3742 | m3935 | 18.6 ± 2.9 | 16 ± 1.6 |
| HIF-1α-3871 | 3744 | m3937 | 15.3 ± 11.4 | 17.4 ± 8.2 |
| HIF-1α-3873 | 3746 | m3939 | 15.6 ± 3.9 | 13.4 ± 5.4 |
| HIF-1α-3875 | 3748 | m3941 | 25.2 ± 8.8 | 17.6 ± 7.3 |
| HIF-1α-3877 | 3750 | m3943 | 15.9 ± 4.9 | 11.2 ± 3.6 |
| HIF-1α-3880 | 3753 | N/A | 18 ± 7.8 | 13.8 ± 5.2 |
| HIF-1α-3916 | 3789 | m3981 | 12.8 ± 10.3 | 12.9 ± 12.7 |
| HIF-1α-3918 | 3791 | m3983 | 20.6 ± 11 | 16.1 ± 10 |
| HIF-1α-3920 | 3793 | m3985 | 29.7 ± 6.2 | 17.8 ± 2.6 |
| HIF-1α-3922 | 3795 | m3987 | 19.7 ± 9.1 | 13.9 ± 7.3 |
| HIF-1α-3924 | 3797 | m3989 | 29.1 ± 10.8 | 14.4 ± 18.4 |
| HIF-1α-3926 | 3799 | m3991 | 21.7 ± 6 | 15 ± 4.3 |
| HIF-1α-3928 | 3801 | m3993 | 19.8 ± 6.8 | 15.1 ± 5.2 |
| HIF-1α-3930 | 3803 | m3995 | 12.2 ± 10.3 | 8.9 ± 7.5 |
| HIF-1α-3961 | 3834 | N/A | 24.2 ± 7.9 | 22.9 ± 9.4 |
| HIF-1α-3980 | 3853 | N/A | 17.9 ± 4.1 | 12.1 ± 7.4 |
| HIF-1α-3999 | 3872 | N/A | 22 ± 4 | 19 ± 3.3 |
| HIF-1α-4000 | 3873 | N/A | 21.1 ± 6.8 | 27.6 ± 6.3 |
| HIF-1α-4001 | 3874 | N/A | 29.1 ± 10.8 | 14.2 ± 11.5 |
| HIF-1α-4003 | 3876 | N/A | 22.3 ± 4.6 | 23.7 ± 2.2 |
| HIF-1α-4004 | 3877 | N/A | 18.7 ± 4.9 | 17.5 ± 2.5 |
| HIF-1α-4005 | 3878 | N/A | 16.5 ± 7.1 | 13.9 ± 9.2 |
| HIF-1α-4006 | 3879 | N/A | 24.5 ± 5.8 | 18.3 ± 6.4 |
| HIF-1α-4007 | 3880 | N/A | 28 ± 15.9 | 21.1 ± 2.9 |
| HIF-1α-4008 | 3881 | N/A | 21.6 ± 8.4 | 18.6 ± 8.3 |
| HIF-1α-4009 | 3882 | N/A | 23.3 ± 6.9 | 17.8 ± 6 |
| HIF-1α-4010 | 3883 | N/A | 18.9 ± 4.1 | 17.2 ± 6.2 |
| HIF-1α-4012 | 3885 | N/A | 19.8 ± 10.2 | 10.7 ± 2 |
| HIF-1α-4055 | 3928 | m4119 | 22 ± 5.2 | 25.6 ± 3.3 |
| HIF-1α-4057 | 3930 | m4121 | 19.1 ± 12.5 | 16.1 ± 8.8 |
| HIF-1α-4059 | 3932 | m4123 | 29.4 ± 10.6 | 19.1 ± 4.4 |
| HIF-1α-4061 | 3934 | m4125 | 35.4 ± 3.3 | 31.4 ± 4 |
| HIF-1α-4063 | 3936 | m4127 | 54.8 ± 10.5 | 46.1 ± 5.6 |
| HIF-1α-4065 | 3938 | m4129 | 49.3 ± 8.5 | 36.6 ± 8 |

TABLE 9

HIF-1α Inhibitory Efficacy of DsiRNAs Assayed at 1 nM in Mouse HEPA1-6 Cells

| DsiRNA Name (Human HIF-1α Target Location, Transcript Variant 1) | Human HIF-1α Target Location, Transcript Variant 2 | Mouse HIF-1α Target Location/ DsiRNA Name | % Remaining HIF-1α mRNA ± % Error (Assay: Mm HIF-1α 1055-1223) | % Remaining HIF-1α mRNA ± % Error (Assay: Mm HIF-1α 2463-2593) |
|---|---|---|---|---|
| HIF-1α-81 | 81 | m103 | 135.6 ± 5.4 | 125.9 ± 5.7 |
| HIF-1α-83 | 83 | m105 | 113.8 ± 5.6 | 118.1 ± 4.1 |
| HIF-1α-85 | 85 | m107 | 142.8 ± 9.5 | 153.3 ± 1.2 |
| HIF-1α-87 | 87 | m109 | 98.9 ± 9 | 102 ± 5.2 |
| HIF-1α-89 | 89 | m111 | 153.1 ± 5.1 | 150.8 ± 3.2 |
| HIF-1α-427 | 427 | m446 | 117.6 ± 10.9 | 124.5 ± 6.9 |
| HIF-1α-429 | 429 | m448 | 142.5 ± 5 | 108.6 ± 11.4 |
| HIF-1α-469 | 469 | m488 | 59.8 ± 9.2 | 55.2 ± 8 |
| HIF-1α-471 | 471 | m490 | 37.9 ± 14.5 | 35 ± 16 |
| HIF-1α-473 | 473 | m492 | 23.4 ± 8.9 | 25.3 ± 4.5 |

TABLE 9-continued

HIF-1α Inhibitory Efficacy of DsiRNAs Assayed at 1 nM in Mouse HEPA1-6 Cells

| DsiRNA Name (Human HIF-1α Target Location, Transcript Variant 1) | Human HIF-1α Target Location, Transcript Variant 2 | Mouse HIF-1α Target Location/ DsiRNA Name | % Remaining HIF-1α mRNA ± % Error (Assay: Mm HIF-1α 1055-1223) | % Remaining HIF-1α mRNA ± % Error (Assay: Mm HIF-1α 2463-2593) |
|---|---|---|---|---|
| HIF-1α-475 | 475 | m494 | 40.5 ± 6 | 49.7 ± 5.2 |
| HIF-1α-528 | 528 | m547 | 81.6 ± 3.3 | 77 ± 3.4 |
| HIF-1α-530 | 530 | m549 | 67.2 ± N/A | 62.5 ± N/A |
| HIF-1α-532 | 532 | m551 | 62 ± 3 | 59.4 ± 4.3 |
| HIF-1α-534 | 534 | m553 | 54.2 ± 8.1 | 39.8 ± 9.9 |
| HIF-1α-536 | 536 | m555 | 81.2 ± 6 | 74.9 ± 5.8 |
| HIF-1α-538 | 538 | m557 | 83.6 ± 5.8 | 72.6 ± 7.6 |
| HIF-1α-540 | 540 | m559 | 59.9 ± 9.5 | 54.8 ± 8.1 |
| HIF-1α-542 | 542 | m561 | 47 ± 5.2 | 54 ± 10.3 |
| HIF-1α-544 | 544 | m563 | 51.2 ± 10.2 | 42.7 ± 7.8 |
| HIF-1α-546 | 546 | m565 | 45.7 ± 9.5 | 46.8 ± 5.6 |
| HIF-1α-548 | 548 | m567 | 42.8 ± 11.4 | 40.3 ± 9.8 |
| HIF-1α-550 | 550 | m569 | 25.9 ± 6.3 | 22.2 ± 8.5 |
| HIF-1α-793 | 793 | m812 | 59.6 ± 10.9 | 58.6 ± 8.8 |
| HIF-1α-824 | 824 | m843 | 52.6 ± 17.7 | 53.6 ± 17 |
| HIF-1α-826 | 826 | m845 | 53.1 ± 3.3 | 65.4 ± 6.8 |
| HIF-1α-828 | 828 | m847 | 48.6 ± 5.6 | 54.6 ± 16.5 |
| HIF-1α-830 | 830 | m849 | 93 ± 14.1 | 127.5 ± 8.6 |
| HIF-1α-832 | 832 | m851 | 57.9 ± 3.6 | 64.6 ± 1.1 |
| HIF-1α-834 | 834 | m853 | 38.3 ± 6.1 | 51.9 ± 5.8 |
| HIF-1α-836 | 836 | m855 | 70.9 ± 8.5 | 67.2 ± 5.7 |
| HIF-1α-838 | 838 | m857 | 56.9 ± 11.6 | 62.9 ± 14 |
| HIF-1α-840 | 840 | m859 | 54.7 ± 9.1 | 56.8 ± 7 |
| HIF-1α-842 | 842 | m861 | 38.6 ± 12.2 | 45.6 ± 9.7 |
| HIF-1α-844 | 844 | m863 | 32.4 ± 8.4 | 27.6 ± 4.9 |
| HIF-1α-846 | 846 | m865 | 38.5 ± 11 | 49.4 ± 4.4 |
| HIF-1α-848 | 848 | m867 | 38.2 ± 7.3 | 43.1 ± 14.2 |
| HIF-1α-850 | 850 | m869 | 33.7 ± 7.4 | 39.1 ± 8.4 |
| HIF-1α-852 | 852 | m871 | 41.3 ± 3.9 | 40.4 ± 2.6 |
| HIF-1α-925 | 925 | m944 | 66.8 ± 6.7 | 74.6 ± 2.8 |
| HIF-1α-927 | 927 | m946 | 87.5 ± 4.1 | 95 ± 2 |
| HIF-1α-1029 | 1029 | m1048 | 81.2 ± 3.7 | 88.2 ± 4.2 |
| HIF-1α-1031 | 1031 | m1050 | 67.4 ± 6.9 | 61.9 ± 5.7 |
| HIF-1α-1033 | 1033 | m1052 | 80.5 ± 10.4 | 94.1 ± 9.5 |
| HIF-1α-1035 | 1035 | m1054 | 24 ± N/A | 26.6 ± N/A |
| HIF-1α-1037 | 1037 | m1056 | 74.5 ± 6.8 | 89.1 ± 7.5 |
| HIF-1α-1039 | 1039 | m1058 | 83.8 ± 10.4 | 88.1 ± 3.7 |
| HIF-1α-1041 | 1041 | m1060 | 108.5 ± 4.1 | 120.6 ± 4.8 |
| HIF-1α-1043 | 1043 | m1062 | 86.2 ± 4.9 | 91 ± 2.5 |
| HIF-1α-1045 | 1045 | m1064 | 72 ± 8.4 | 90.5 ± 4.9 |
| HIF-1α-1084 | 1084 | m1103 | 22.7 ± 4.8 | 25.7 ± 26.6 |
| HIF-1α-1086 | 1086 | m1105 | 64.9 ± 9.6 | 86.9 ± 10.5 |
| HIF-1α-1088 | 1088 | m1107 | 24.6 ± 15.6 | 30.7 ± 13.2 |
| HIF-1α-1090 | 1090 | m1109 | 20.6 ± 20.4 | 24.8 ± 16.4 |
| HIF-1α-1092 | 1092 | m1111 | 46.5 ± 11.7 | 71.4 ± 10.4 |
| HIF-1α-1094 | 1094 | m1113 | 40.8 ± 4 | 44.9 ± 3.9 |
| HIF-1α-1096 | 1096 | m1115 | 71.8 ± 6.2 | 86.2 ± 4.6 |
| HIF-1α-1120 | 1120 | m1139 | 29.2 ± 15.9 | 35.3 ± 14.4 |
| HIF-1α-1122 | 1122 | m1141 | 15.1 ± 21.8 | 9.8 ± 13 |
| HIF-1α-1124 | 1124 | m1143 | 34.8 ± 7.6 | 47.8 ± 8.4 |
| HIF-1α-1126 | 1126 | m1145 | 49.8 ± 2.3 | 64.1 ± 3.5 |
| HIF-1α-1128 | 1128 | m1147 | 26.4 ± 7.5 | 30.8 ± 4.4 |
| HIF-1α-1130 | 1130 | m1149 | 30.5 ± 4.1 | 37.5 ± 7.6 |
| HIF-1α-1132 | 1132 | m1151 | 76.1 ± 1.6 | 85.9 ± 2.2 |
| HIF-1α-1243 | 1243 | m1262 | 21.2 ± 11.8 | 26 ± 11.8 |
| HIF-1α-1245 | 1245 | m1264 | 15.8 ± 9.3 | 29.8 ± 34.7 |
| HIF-1α-1247 | 1247 | m1266 | 24.9 ± 4.9 | 17.8 ± 2.4 |
| HIF-1α-1249 | 1249 | m1268 | 23.8 ± 6.7 | 32.5 ± 4.3 |
| HIF-1α-1251 | 1251 | m1270 | 56.8 ± 3.1 | 69.1 ± 3.1 |
| HIF-1α-1253 | 1253 | m1272 | 65.3 ± 3.4 | 63.9 ± 2 |
| HIF-1α-1255 | 1255 | m1274 | 70.5 ± 6.1 | 80.6 ± 7.4 |
| HIF-1α-1257 | 1257 | m1276 | 76.2 ± 7 | 89.9 ± 3.4 |
| HIF-1α-1278 | 1278 | m1297 | 33.5 ± 1.5 | 34.9 ± 3.2 |
| HIF-1α-1280 | 1280 | m1299 | 14.6 ± 2.4 | 17.8 ± 2.6 |
| HIF-1α-1282 | 1282 | m1301 | 14.3 ± 15.9 | 16.6 ± 15.3 |
| HIF-1α-1303 | 1303 | m1322 | 9.6 ± 8.3 | 13.2 ± 12.6 |
| HIF-1α-1305 | 1305 | m1324 | 17.7 ± 13.9 | 25.4 ± 10.5 |
| HIF-1α-1307 | 1307 | m1326 | 38 ± 6.2 | 48.7 ± 7.4 |
| HIF-1α-1309 | 1309 | m1328 | 31.7 ± 10.9 | 53.7 ± 8.1 |
| HIF-1α-1311 | 1311 | m1330 | 37.1 ± 4.4 | 45.3 ± 4.3 |
| HIF-1α-1313 | 1313 | m1332 | 32.9 ± 3.1 | 36.3 ± 3.1 |

TABLE 9-continued

HIF-1α Inhibitory Efficacy of DsiRNAs Assayed at 1 nM in Mouse HEPA1-6 Cells

| DsiRNA Name (Human HIF-1α Target Location, Transcript Variant 1) | Human HIF-1α Target Location, Transcript Variant 2 | Mouse HIF-1α Target Location/ DsiRNA Name | % Remaining HIF-1α mRNA ± % Error (Assay: Mm HIF-1α 1055-1223) | % Remaining HIF-1α mRNA ± % Error (Assay: Mm HIF-1α 2463-2593) |
|---|---|---|---|---|
| HIF-1α-1315 | 1315 | m1334 | 11.2 ± 7.7 | 20.2 ± 4.6 |
| HIF-1α-1317 | 1317 | m1336 | 34 ± 8.1 | 36.9 ± 4.3 |
| HIF-1α-1319 | 1319 | m1338 | 24.9 ± 6.4 | 32.1 ± 1.8 |
| HIF-1α-1321 | 1321 | m1340 | 42 ± 3 | 43.9 ± 1.7 |
| HIF-1α-1323 | 1323 | m1342 | 32.7 ± 13.5 | 35.4 ± 4.5 |
| HIF-1α-1325 | 1325 | m1344 | 17.2 ± 5.2 | 22.5 ± 5.3 |
| HIF-1α-1327 | 1327 | m1346 | 54.9 ± 5.6 | 55.2 ± 2.3 |
| HIF-1α-1329 | 1329 | m1348 | 15.3 ± 4.5 | 15.4 ± 3.8 |
| HIF-1α-1331 | 1331 | m1350 | 38.1 ± 11.5 | 40.3 ± 7.1 |
| HIF-1α-1333 | 1333 | m1352 | 15.3 ± 11.8 | 16.9 ± 9.6 |
| HIF-1α-1335 | 1335 | m1354 | 10.8 ± 10.5 | 15.6 ± 6.6 |
| HIF-1α-1337 | 1337 | m1356 | 12.6 ± 6.7 | 15.3 ± 5.9 |
| HIF-1α-1339 | 1339 | m1358 | 13.3 ± 7.3 | 16.2 ± 5 |
| HIF-1α-1341 | 1341 | m1360 | 28.4 ± 13.9 | 31.3 ± 2.6 |
| HIF-1α-1343 | 1343 | m1362 | 22.5 ± 9.72 | 5.1 ± 10.7 |
| HIF-1α-1345 | 1345 | m1364 | 24.6 ± 11.8 | 29.1 ± 15.4 |
| HIF-1α-1347 | 1347 | m1366 | 39.3 ± 8.3 | 48.7 ± 5.2 |
| HIF-1α-1349 | 1349 | m1368 | 14.3 ± 15.6 | 16.3 ± 20.7 |
| HIF-1α-1351 | 1351 | m1370 | 31.1 ± N/A | 39.4 ± N/A |
| HIF-1α-1353 | 1353 | m1372 | 34.5 ± 3.7 | 37.6 ± 2 |
| HIF-1α-1355 | 1355 | m1374 | 16.8 ± 10.5 | 21.7 ± 9.3 |
| HIF-1α-1357 | 1357 | m1376 | 25.2 ± 16.9 | 30.7 ± 13.9 |
| HIF-1α-1359 | 1359 | m1378 | 19.9 ± 7.8 | 21.1 ± 10.8 |
| HIF-1α-1361 | 1361 | m1380 | 17.9 ± 7.2 | 20.9 ± 9.4 |
| HIF-1α-1363 | 1363 | m1382 | 10.9 ± 14.6 | 12.1 ± 11.4 |
| HIF-1α-1365 | 1365 | m1384 | 18 ± 2 | 15.2 ± 4.2 |
| HIF-1α-1367 | 1367 | m1386 | 26.2 ± 5.2 | 34.9 ± 2.9 |
| HIF-1α-1369 | 1369 | m1388 | 11.3 ± 8.3 | 12.9 ± 11.8 |
| HIF-1α-1371 | 1371 | m1390 | 29.5 ± 5.3 | 35.3 ± 7.5 |
| HIF-1α-1373 | 1373 | m1392 | 12.2 ± 2.5 | 15 ± 4.6 |
| HIF-1α-1375 | 1375 | m1394 | 13.8 ± 8.2 | 14.9 ± 6.8 |
| HIF-1α-1377 | 1377 | m1396 | 18.5 ± 4.1 | 19.6 ± 3.4 |
| HIF-1α-1379 | 1379 | m1398 | 14.6 ± 10 | 18.8 ± 5.1 |
| HIF-1α-1381 | 1381 | m1400 | 9.1 ± 3.2 | 8.3 ± 2 |
| HIF-1α-1383 | 1383 | m1402 | 18.7 ± 5.7 | 21.7 ± 3.1 |
| HIF-1α-1385 | 1385 | m1404 | 6.2 ± 6.9 | 7.4 ± 3.9 |
| HIF-1α-1387 | 1387 | m1406 | 19.1 ± 13.3 | 20.9 ± 10 |
| HIF-1α-1456 | 1456 | m1475 | 11.2 ± 8.8 | 12.9 ± 5.3 |
| HIF-1α-1458 | 1458 | m1477 | 10.4 ± 16.4 | 11 ± 9.6 |
| HIF-1α-1460 | 1460 | m1479 | 21.3 ± 6.3 | 21.6 ± 7.3 |
| HIF-1α-1462 | 1462 | m1481 | 18.9 ± 9.9 | 19.1 ± 10 |
| HIF-1α-1464 | 1464 | m1483 | 28.2 ± 12.2 | 26 ± 2 |
| HIF-1α-1466 | 1466 | m1485 | N/A ± N/A | N/A ± N/A |
| HIF-1α-1468 | 1468 | m1487 | 15.1 ± 8.8 | 13.4 ± 9.3 |
| HIF-1α-1470 | 1470 | m1489 | 13 ± 6.2 | 14.6 ± 8.6 |
| HIF-1α-1472 | 1472 | m1491 | 12.9 ± 12.4 | 26.2 ± 23.1 |
| HIF-1α-1474 | 1474 | m1493 | 16.3 ± 6.6 | 20.4 ± 3.8 |
| HIF-1α-1476 | 1476 | m1495 | 18.3 ± 9.3 | 18.1 ± 10.9 |
| HIF-1α-1478 | 1478 | m1497 | 9.3 ± 12.5 | 9.4 ± 12.6 |
| HIF-1α-1480 | 1480 | m1499 | 30.3 ± 10.7 | 21.8 ± 10.7 |
| HIF-1α-1482 | 1482 | m1501 | 23.9 ± 3.6 | 27 ± 0.8 |
| HIF-1α-1519 | 1519 | m1538 | 57.9 ± 5.6 | 55.1 ± 11.2 |
| HIF-1α-1552 | 1552 | m1571 | 17 ± 4.7 | 16.6 ± 3 |
| HIF-1α-1714 | 1714 | m1733 | 36.7 ± 4 | 38.1 ± 3.1 |
| HIF-1α-1804 | 1804 | m1820 | 25.4 ± 6.4 | 24.7 ± 8.1 |
| HIF-1α-1806 | 1806 | m1822 | 59.2 ± 1.6 | 53.1 ± 1.1 |
| HIF-1α-1808 | 1808 | m1824 | 46.7 ± 14.8 | 44.6 ± 13.4 |
| HIF-1α-1810 | 1810 | m1826 | 69.6 ± 8.2 | 55.3 ± 5.2 |
| HIF-1α-1936 | 1936 | m1952 | 14.4 ± 8.2 | 14.9 ± 12.6 |
| HIF-1α-1938 | 1938 | m1954 | 11.6 ± 4 | 9 ± 2.8 |
| HIF-1α-1940 | 1940 | m1956 | 17.8 ± 4.1 | 17 ± 4.4 |
| HIF-1α-1942 | 1942 | m1958 | 38.3 ± 6 | 42.6 ± 8.9 |
| HIF-1α-1944 | 1944 | m1960 | 30.5 ± 10.4 | 30.6 ± 10.3 |
| HIF-1α-1946 | 1946 | m1962 | 62 ± 3.7 | 58.9 ± 5.4 |
| HIF-1α-2116 | 2116 | m2174 | 10.5 ± 14.9 | 10.6 ± 14.3 |

TABLE 9-continued

HIF-1α Inhibitory Efficacy of DsiRNAs Assayed at 1 nM in Mouse HEPA1-6 Cells

| DsiRNA Name (Human HIF-1α Target Location, Transcript Variant 1) | Human HIF-1α Target Location, Transcript Variant 2 | Mouse HIF-1α Target Location/ DsiRNA Name | % Remaining HIF-1α mRNA ± % Error (Assay: Mm HIF-1α 1055-1223) | % Remaining HIF-1α mRNA ± % Error (Assay: Mm HIF-1α 2463-2593) |
|---|---|---|---|---|
| HIF-1α-2118 | 2118 | m2176 | 10.4 ± 5.9 | 9.6 ± 5.4 |
| HIF-1α-2120 | 2120 | m2178 | 8 ± 13.2 | 6.9 ± 18 |
| HIF-1α-2122 | 2122 | m2180 | 25.5 ± 6.9 | 27.5 ± 7.5 |
| HIF-1α-2161 | 2161 | m2219 | 12.2 ± 6.1 | 12.3 ± 2.8 |
| HIF-1α-2452 | 2452 | m2504 | 14.3 ± 7.9 | 15.4 ± 13.1 |
| HIF-1α-2584 | 2584 | m2633 | 20 ± 11.3 | 17.6 ± 9.5 |
| HIF-1α-2586 | 2586 | m2635 | 16.2 ± 6.1 | 14.4 ± 11.3 |
| HIF-1α-2705 | N/A | m2754 | 16 ± 4.4 | 14.3 ± 6.1 |
| HIF-1α-2796 | 2669 | m2845 | 9.2 ± 7 | 7 ± 6.8 |
| HIF-1α-2798 | 2671 | m2847 | 11 ± 8.2 | 5.7 ± 5.9 |
| HIF-1α-2800 | 2673 | m2849 | 8.3 ± 3.9 | 6.4 ± 4.2 |
| HIF-1α-2802 | 2675 | m2851 | 9.3 ± 11.3 | 7.6 ± 10.4 |
| HIF-1α-2823 | 2696 | m2872 | 27.4 ± 5 | 27.5 ± 3.1 |
| HIF-1α-2844 | 2717 | m2893 | 23.3 ± 4.6 | 22.5 ± 4.3 |
| HIF-1α-2846 | 2719 | m2895 | 34 ± 4 | 29.9 ± 3 |
| HIF-1α-2848 | 2721 | m2897 | 30 ± 2.2 | 26.5 ± 6 |
| HIF-1α-2850 | 2723 | m2899 | 18.5 ± 3.8 | 16.7 ± 3.8 |
| HIF-1α-2852 | 2725 | m2901 | 9.7 ± 10 | 6 ± 6.2 |
| HIF-1α-2854 | 2727 | m2903 | 11.5 ± 11.1 | 10.5 ± 5.5 |
| HIF-1α-2856 | 2729 | m2905 | 7.4 ± 18.7 | 5.6 ± 21.9 |
| HIF-1α-2858 | 2731 | m2907 | 7.5 ± 5.4 | 5.6 ± 5 |
| HIF-1α-2860 | 2733 | m2909 | 8.3 ± 2.6 | 6.1 ± 8.6 |
| HIF-1α-2862 | 2735 | m2911 | 9.9 ± 8.6 | 6.4 ± 9 |
| HIF-1α-2864 | 2737 | m2913 | 10.4 ± 8 | 7.1 ± 6.8 |
| HIF-1α-2866 | 2739 | m2915 | 6.9 ± 6.9 | 5.7 ± 10.9 |
| HIF-1α-2868 | 2741 | m2917 | 10.7 ± 9.2 | 8.9 ± 10.7 |
| HIF-1α-2870 | 2743 | m2919 | 7.4 ± 4.5 | 6.1 ± 9.8 |
| HIF-1α-2872 | 2745 | m2921 | 11 ± 8.7 | 11.4 ± 9.1 |
| HIF-1α-2874 | 2747 | m2923 | 7.7 ± 7.4 | 6.4 ± 3.3 |
| HIF-1α-2876 | 2749 | m2925 | 8.5 ± 12.6 | 7.7 ± 20.7 |
| HIF-1α-2878 | 2751 | m2927 | 11.8 ± 13.4 | 7.9 ± 15.7 |
| HIF-1α-2880 | 2753 | m2929 | 7.9 ± 16.5 | 5.5 ± 17.1 |
| HIF-1α-2882 | 2755 | m2931 | 8.8 ± 2.5 | 5.9 ± 2.4 |
| HIF-1α-2884 | 2757 | m2933 | 8 ± 5.3 | 5.9 ± 19.9 |
| HIF-1α-2886 | 2759 | m2935 | 4.9 ± 7 | 3.4 ± 1.2 |
| HIF-1α-2888 | 2761 | m2937 | 10.4 ± 9 | 8.5 ± 3.4 |
| HIF-1α-2890 | 2763 | m2939 | 6.5 ± 13.6 | 4.8 ± 9.5 |
| HIF-1α-2892 | 2765 | m2941 | 24.3 ± 11.1 | 21.5 ± 9.4 |
| HIF-1α-2933 | 2806 | m3042 | 19.3 ± 3.8 | 14 ± 5.1 |
| HIF-1α-2935 | 2808 | m3044 | 26.2 ± 3.6 | 21.9 ± 7.6 |
| HIF-1α-2963 | 2836 | m3063 | 10.3 ± 4.8 | 7.4 ± 7.5 |
| HIF-1α-2965 | 2838 | m3065 | 17.4 ± 2.3 | 12.3 ± 2.5 |
| HIF-1α-2986 | 2859 | m3086 | 21.3 ± 4.3 | 17.6 ± 4.6 |
| HIF-1α-2988 | 2861 | m3088 | 15.1 ± 3.8 | 10 ± 3.9 |
| HIF-1α-2990 | 2863 | m3090 | 15.9 ± 13.7 | 11.9 ± 10.8 |
| HIF-1α-2992 | 2865 | m3092 | 20.4 ± 5.4 | 15.2 ± 6.8 |
| HIF-1α-2994 | 2867 | m3094 | 31.6 ± 4.3 | 25.2 ± 0.7 |
| HIF-1α-2996 | 2869 | m3096 | 31 ± 6.6 | 17.1 ± 4.5 |
| HIF-1α-2998 | 2871 | m3098 | 21.5 ± 12.8 | 14.6 ± 8.9 |
| HIF-1α-3000 | 2873 | m3100 | 32.2 ± 9.9 | 24.1 ± 6.4 |
| HIF-1α-3002 | 2875 | m3102 | N/A ± N/A | N/A ± N/A |
| HIF-1α-3004 | 2877 | m3104 | 20.6 ± 10.8 | 17.7 ± 8.1 |
| HIF-1α-3167 | 3040 | m3257 | 21.2 ± 4.5 | 16.1 ± 7.5 |
| HIF-1α-3169 | 3042 | m3259 | 19.7 ± 21.4 | 21.6 ± 9.1 |
| HIF-1α-3171 | 3044 | m3261 | 22 ± 3.6 | 16.4 ± 2.5 |
| HIF-1α-3173 | 3046 | m3263 | 33.6 ± 10.7 | 26 ± 9.3 |
| HIF-1α-3175 | 3048 | m3265 | 55.3 ± 6.1 | 54.8 ± 3.3 |
| HIF-1α-3177 | 3050 | m3267 | 167.9 ± 1.1 | 184.3 ± 0.9 |
| HIF-1α-3179 | 3052 | m3269 | 157 ± 9.7 | 155.3 ± 5.1 |
| HIF-1α-3274 | 3147 | m3362 | 22.8 ± 9 | 18.2 ± 18 |
| HIF-1α-3276 | 3149 | m3364 | 18.8 ± 4.9 | 15.2 ± 2 |
| HIF-1α-3278 | 3151 | m3366 | 18.9 ± 9 | 15.9 ± 5.7 |
| HIF-1α-3280 | 3153 | m3368 | 30.6 ± 5.3 | 26.1 ± 4 |
| HIF-1α-3358 | 3231 | m3444 | 20.2 ± 10 | 12.1 ± 10.9 |

TABLE 9-continued

HIF-1α Inhibitory Efficacy of DsiRNAs Assayed at 1 nM in Mouse HEPA1-6 Cells

| DsiRNA Name (Human HIF-1α Target Location, Transcript Variant 1) | Human HIF-1α Target Location, Transcript Variant 2 | Mouse HIF-1α Target Location/ DsiRNA Name | % Remaining HIF-1α mRNA ± % Error (Assay: Mm HIF-1α 1055-1223) | % Remaining HIF-1α mRNA ± % Error (Assay: Mm HIF-1α 2463-2593) |
|---|---|---|---|---|
| HIF-1α-3360 | 3233 | m3446 | 21.7 ± 9.9 | 14.1 ± 10.3 |
| HIF-1α-3362 | 3235 | m3448 | 15.3 ± 7.5 | 12 ± 5 |
| HIF-1α-3364 | 3237 | m3450 | 15.7 ± 17.7 | 12.5 ± 11.8 |
| HIF-1α-3366 | 3239 | m3452 | 15 ± 11.8 | 14.2 ± 7 |
| HIF-1α-3368 | 3241 | m3454 | 17.5 ± 4 | 12.8 ± 3.8 |
| HIF-1α-3426 | 3299 | m3511 | 56.8 ± 2.9 | 51.7 ± 8.1 |
| HIF-1α-3428 | 3301 | m3513 | 146.3 ± 2.8 | 163.7 ± 4.8 |
| HIF-1α-3430 | 3303 | m3515 | 88.3 ± 3.8 | 77.7 ± 3 |
| HIF-1α-3448 | 3321 | m3530 | 27.2 ± N/A | 22.3 ± N/A |
| HIF-1α-3450 | 3323 | m3532 | 25.4 ± 24.3 | 12.3 ± 14 |
| HIF-1α-3546 | 3419 | m3620 | 14.8 ± 5.5 | 11.1 ± 5.4 |
| HIF-1α-3592 | 3465 | m3666 | 25.2 ± 8.2 | 22.5 ± 7.6 |
| HIF-1α-3594 | 3467 | m3668 | 26 ± 12.8 | 20.4 ± 12.2 |
| HIF-1α-3596 | 3469 | m3670 | 26.5 ± 4.5 | 15.7 ± 7.2 |
| HIF-1α-3598 | 3471 | m3672 | 24 ± 5.5 | 17.4 ± 7.3 |
| HIF-1α-3600 | 3473 | m3674 | 15.6 ± 5.8 | 9.9 ± 2.7 |
| HIF-1α-3602 | 3475 | m3676 | 19.4 ± 8.9 | 16.1 ± 9.9 |
| HIF-1α-3604 | 3477 | m3678 | 22.3 ± 11.6 | 14 ± 7.2 |
| HIF-1α-3606 | 3479 | m3680 | 12.1 ± 6.6 | 9.3 ± 4.8 |
| HIF-1α-3608 | 3481 | m3682 | 18.9 ± 7.1 | 17.9 ± 6 |
| HIF-1α-3608 | 3481 | m3682 | 21 ± 10.8 | 17.7 ± 9.7 |
| HIF-1α-3610 | 3483 | m3684 | 19.9 ± 3.9 | 17.6 ± 4.3 |
| HIF-1α-3612 | 3485 | m3686 | 21 ± 14.9 | 14.4 ± 10.9 |
| HIF-1α-3614 | 3487 | m3688 | 49.1 ± 7.2 | 43.1 ± 4.9 |
| HIF-1α-3616 | 3489 | m3690 | 54.6 ± 7.9 | 47.2 ± 7.8 |
| HIF-1α-3861 | 3734 | m3927 | 15.7 ± 8.2 | 12.5 ± 4.1 |
| HIF-1α-3863 | 3736 | m3929 | 15.7 ± 1.8 | 10.7 ± 4.1 |
| HIF-1α-3865 | 3738 | m3931 | 11.1 ± 3.8 | 8.6 ± 4.5 |
| HIF-1α-3867 | 3740 | m3933 | 12.8 ± 7.2 | 11.5 ± 1.9 |
| HIF-1α-3869 | 3742 | m3935 | 13.1 ± 12.4 | 11.2 ± 14.9 |
| HIF-1α-3871 | 3744 | m3937 | 15.4 ± 15.8 | 10.6 ± 5.1 |
| HIF-1α-3873 | 3746 | m3939 | 17.4 ± 3.3 | 13.2 ± 2.1 |
| HIF-1α-3875 | 3748 | m3941 | 21.9 ± 2.8 | 17.4 ± 3 |
| HIF-1α-3877 | 3750 | m3943 | 18.6 ± 8.1 | 14.7 ± 9.8 |
| HIF-1α-3916 | 3789 | m3981 | 14.2 ± 2.8 | 9.3 ± 11.2 |
| HIF-1α-3918 | 3791 | m3983 | 12.3 ± 8.3 | 10.2 ± 6.9 |
| HIF-1α-3920 | 3793 | m3985 | 26.1 ± 5.9 | 24.5 ± 12 |
| HIF-1α-3922 | 3795 | m3987 | 15 ± 15.5 | 13.8 ± 17.2 |
| HIF-1α-3924 | 3797 | m3989 | 14.4 ± 21.4 | 18.1 ± 7.1 |
| HIF-1α-3926 | 3799 | m3991 | 22.8 ± 3.5 | 19.4 ± 2.2 |
| HIF-1α-3928 | 3801 | m3993 | 25.5 ± 4.5 | 20 ± 9.1 |
| HIF-1α-3930 | 3803 | m3995 | 13.7 ± 17.2 | 11.7 ± 17.3 |
| HIF-1α-4055 | 3928 | m4119 | 60.3 ± 5.5 | 48.6 ± 3.4 |
| HIF-1α-4057 | 3930 | m4121 | 14.7 ± 9.3 | 15.2 ± 7.5 |
| HIF-1α-4059 | 3932 | m4123 | 28.6 ± 7.3 | 25.4 ± 6.7 |
| HIF-1α-4061 | 3934 | m4125 | 30.5 ± 8.3 | 32 ± 8 |
| HIF-1α-4063 | 3936 | m4127 | 49.5 ± 14.5 | 57.7 ± 10.6 |
| HIF-1α-4065 | 3938 | m4129 | 50.6 ± 4 | 46.2 ± 5.3 |
| | | HIF-1α-m38 | 154 ± 4.2 | 160.3 ± 2.5 |
| | | HIF-1α-m40 | 114.5 ± 3.4 | 121.7 ± 2.6 |
| | | HIF-1α-m41 | 96.9 ± 12 | 127.7 ± 7.4 |
| | | HIF-1α-m42 | 145.7 ± 3.4 | 158.3 ± 3.3 |
| | | HIF-1α-m43 | 129.5 ± 17.5 | 121.4 ± 9.8 |
| | | HIF-1α-m44 | 151 ± 2.9 | 184.2 ± 9.7 |
| | | HIF-1α-m45 | 116.4 ± 11.2 | 96 ± 17.8 |
| | | HIF-1α-m46 | 128.7 ± 5.6 | 143.4 ± 3.6 |
| | | HIF-1α-m47 | 155.1 ± 3.2 | 159.6 ± 2 |
| | | HIF-1α-m49 | 137.5 ± 5.4 | 161.2 ± 4 |
| | | HIF-1α-m50 | 127.5 ± 7.1 | 124.6 ± 7 |
| | | HIF-1α-m51 | 147.4 ± 4 | 147.6 ± 9.2 |
| | | HIF-1α-m52 | 143.5 ± 2.2 | 136.5 ± 2.1 |
| | | HIF-1α-m53 | 152.8 ± 3.4 | 171.9 ± 3.4 |
| | | HIF-1α-m55 | 107.6 ± 4.3 | 125.6 ± 3.6 |
| | | HIF-1α-m97 | 87.7 ± 10.6 | 89.8 ± 7.1 |
| | | HIF-1α-m98 | 86.1 ± 2.3 | 79.6 ± 0.9 |
| | | HIF-1α-m99 | 130.6 ± 3.4 | 194.7 ± 10.5 |
| | | HIF-1α-m100 | 120.2 ± 3.1 | 128.5 ± 6.7 |
| | | HIF-1α-m139 | 111.2 ± 4.5 | 115.7 ± 1.1 |
| | | HIF-1α-m141 | 132.9 ± 9.2 | 126.4 ± 6.6 |
| | | HIF-1α-m145 | 99.6 ± 7 | 133.6 ± 1.4 |
| | | HIF-1α-m146 | 101.6 ± 20.4 | 119.9 ± 10 |

TABLE 9-continued

HIF-1α Inhibitory Efficacy of DsiRNAs Assayed at 1 nM in Mouse HEPA1-6 Cells

| DsiRNA Name (Human HIF-1α Target Location, Transcript Variant 1) | Human HIF-1α Target Location, Transcript Variant 2 | Mouse HIF-1α Target Location/ DsiRNA Name | % Remaining HIF-1α mRNA ± % Error (Assay: Mm HIF-1α 1055-1223) | % Remaining HIF-1α mRNA ± % Error (Assay: Mm HIF-1α 2463-2593) |
|---|---|---|---|---|
| | | HIF-1α-m148 | 154.3 ± 8.4 | 102.7 ± 10.4 |
| | | HIF-1α-m152 | 97.7 ± 11 | 91 ± 7.2 |
| | | HIF-1α-m271 | 98.7 ± 8.8 | 95 ± 7.4 |
| | | HIF-1α-m277 | 106 ± 3.9 | 121.6 ± 8.5 |
| | | HIF-1α-m282 | 99.6 ± 1.5 | 107.9 ± 11.4 |
| | | HIF-1α-m283 | 155.4 ± 16.4 | 172 ± 11 |
| | | HIF-1α-m284 | 131.2 ± 8.7 | 129.2 ± 6.7 |
| | | HIF-1α-m286 | 122.5 ± 4.1 | 125.5 ± 2.8 |
| | | HIF-1α-m289 | 93 ± 6.1 | 91.4 ± 4.3 |
| | | HIF-1α-m348 | 116.6 ± 7.1 | 100.7 ± 5.1 |
| | | HIF-1α-m350 | 91 ± 10.2 | 86.1 ± 9.3 |
| | | HIF-1α-m352 | 83.2 ± 15.8 | 92.6 ± 9.6 |
| | | HIF-1α-m353 | 157.7 ± 6.8 | 161.8 ± 6.8 |
| | | HIF-1α-m354 | 140.3 ± 2.7 | 169.5 ± 5.7 |
| | | HIF-1α-m357 | 118 ± 2.8 | 123.8 ± 2.5 |
| | | HIF-1α-m359 | 155.6 ± 3.6 | 149.5 ± 4.5 |
| | | HIF-1α-m365 | 107 ± 7.8 | 90.9 ± 7.2 |
| | | HIF-1α-m597 | 107.5 ± 5.6 | 119.5 ± 8.1 |
| | | HIF-1α-m600 | 80.1 ± 8.2 | 85.7 ± 12.4 |
| | | HIF-1α-m712 | 115.2 ± N/A | 139.1 ± N/A |
| | | HIF-1α-m1093 | 73.7 ± 13.8 | 84.1 ± 9.5 |
| | | HIF-1α-m1593 | 76.7 ± 30.7 | 73.6 ± 24.4 |
| | | HIF-1α-m1595 | 64.9 ± 21.2 | 71.5 ± 18.9 |
| | | HIF-1α-m1596 | 92.7 ± 10.7 | 97.6 ± 12.9 |
| | | HIF-1α-m1599 | 104.2 ± 14.9 | 103.7 ± 9.9 |
| | | HIF-1α-m1632 | 92.6 ± 3 | 101.2 ± 2.6 |
| | | HIF-1α-m1633 | 114 ± 12 | 111.3 ± 10.2 |
| | | HIF-1α-m1634 | 111.7 ± 4.6 | 113.8 ± 4.6 |
| | | HIF-1α-m1642 | 89.6 ± 6.4 | 80.8 ± 2.5 |
| | | HIF-1α-m1830 | 91.8 ± 9.2 | 106.3 ± 5.2 |
| | | HIF-1α-m2041 | 82 ± 3.6 | 92.3 ± 5.6 |
| | | HIF-1α-m2043 | 57.4 ± 8.2 | 69.2 ± 7.2 |
| | | HIF-1α-m2045 | 68.3 ± 12.5 | 74.5 ± 5.4 |
| | | HIF-1α-m2650 | 80 ± 26.6 | 81.8 ± 21.5 |
| | | HIF-1α-m3030 | 47.2 ± 10 | 42.7 ± 10.1 |
| | | HIF-1α-m3557 | 72.3 ± 16.7 | 79.5 ± 15.2 |
| | | HIF-1α-m3562 | 68.2 ± 5.6 | 69.9 ± 1.8 |
| | | HIF-1α-m3576 | 29.6 ± 14.3 | 25.9 ± 12.3 |
| | | HIF-1α-m3592 | 55.5 ± 5.3 | 50.4 ± 5.1 |
| | | HIF-1α-m3604 | 85.4 ± 5.9 | 91.8 ± 5 |
| | | HIF-1α-m4023 | 100.2 ± 4.6 | 101.9 ± 4.9 |
| | | HIF-1α-m4064 | 71.4 ± 7 | 69.6 ± 6.6 |
| | | HIF-1α-m4065 | 67.5 ± 11.1 | 74.5 ± 11.6 |
| | | HIF-1α-m4070 | 91.1 ± 6.4 | 70.9 ± 4.4 |
| | | HIF-1α-m4549 | 122.5 ± 5.9 | 149.4 ± 25.2 |
| | | HIF-1α-m4691 | 96.1 ± 6 | 90.1 ± 4.5 |
| | | HIF-1α-m4692 | 102.4 ± 5.9 | 108.7 ± 1.6 |
| | | HIF-1α-m4693 | 132.2 ± 15.8 | 117.7 ± 13.8 |
| | | HIF-1α-m4709 | 88.9 ± 6.8 | 96.5 ± 4.7 |

As shown in above Table 8, 271 of 378 asymmetric DsiRNAs examined in human HeLa cells showed greater than 70% reduction of human HIF-1α levels in HeLa cells at 1 nM. Of these 271 DsiRNAs, 177 exhibited 80% or greater reduction of human HIF-1α levels in HeLa cells at 1 nM. As shown in above Table 9, a number of asymmetric DsiRNAs capable of inhibiting mouse HIF-1α levels in mouse HEPA1-6 cells at 1 nM in the environment of a cell were also identified in such assays. Assay results of Tables 8 and 9 above were also plotted and are shown in FIGS. 2A-2D. It is noted in Table 9 and corresponding FIG. 2D that assays ranging from HIF-1α-81 through HIF-1α-1257 were affected by subpar transfection of Hepa 1-6 cells in these assays (specifically, the HPRT transfection reagent was half as potent in these assays as in all other assays).

In certain embodiments, double stranded nucleic acids were selected that target the following 21 nucleotide target sequences:

TABLE 10

HIF-1α mRNA 21 Nucleotide Target Sequences of Select dsRNAs

| Human HIF-1α Target Location, Transcript Variant 1 | 21 Nucleotide Target Sequence | SEQ ID NO: |
|---|---|---|
| HIF-1α-403 | GUGAAGACAUCGCGGGGACCG | 1656 |
| HIF-1α-469 | AAGUUCUGAACGUCGAAAAGA | 1662 |

TABLE 10-continued

HIF-1α mRNA 21 Nucleotide Target Sequences of Select dsRNAs

| Human HIF-1α Target Location, Transcript Variant 1 | 21 Nucleotide Target Sequence | SEQ ID NO: |
|---|---|---|
| HIF-1α-530 | UCUGAAGUUUUUAUGAGCUU | 1668 |
| HIF-1α-691 | GAUGAAUUGCUUUUAUUUGAA | 1684 |
| HIF-1α-713 | GCCUUGGAUGGUUUUGUUAUG | 1687 |
| HIF-1α-717 | UGGAUGGUUUUGUUAUGGUUC | 1689 |
| HIF-1α-756 | UGAUUUACAUUUCUGAUAAUG | 1690 |
| HIF-1α-824 | GUGUUUGAUUUUACUCAUCCA | 1693 |
| HIF-1α-1041 | ACAGUAACCAACCUCAGUGUG | 1717 |
| HIF-1α-1122 | CAAAUAUUGAAAUUCCUUUAG | 1731 |
| HIF-1α-1262 | UAUUAUCAUGCUUUGGACUCU | 1747 |
| HIF-1α-1268 | CAUGCUUUGGACUCUGAUCAU | 1749 |
| HIF-1α-1271 | GCUUUGGACUCUGAUCAUCUG | 1750 |
| HIF-1α-1343 | UACAGGAUGCUUGCCAAAGA | 1774 |
| HIF-1α-1369 | AUAUGUCUGGGUUGAAACUCA | 1787 |
| HIF-1α-1379 | GUUGAAACUCAAGCAACUGUC | 1792 |
| HIF-1α-1476 | ACUUGAUUUUCUCCCUUCAAC | 1807 |
| HIF-1α-1478 | UUGAUUUUCUCCCUUCAACAA | 1808 |
| HIF-1α-1482 | UUUUCUCCCUUCAACAAACAG | 1810 |
| HIF-1α-1648 | CACAAUCAUAUCUUUAGAUUU | 1814 |
| HIF-1α-1940 | GGAAGCACUAGACAAAGUUCA | 1826 |
| HIF-1α-1944 | GCACUAGACAAAGUUCACCUG | 1828 |
| HIF-1α-1946 | ACUAGACAAAGUUCACCUGAG | 1829 |
| HIF-1α-2034 | UGGUAGAAAAACUUUUUGCUG | 1832 |
| HIF-1α-2730 | AGCAAAAGACAAUUAUUUUAA | 1849 |
| HIF-1α-2852 | GGCAGCAGAAACCUACUGCAG | 1859 |
| HIF-1α-2882 | UUACUCAGAGCUUUUGGAUCAA | 1874 |
| HIF-1α-2890 | AGCUUUGGAUCAAGUUAACUG | 1878 |
| HIF-1α-2925 | UUCAUUCCUUUUUUUGGACAC | 1884 |
| HIF-1α-2933 | UUUUUUUGGACACUGGUGGCU | 1885 |
| HIF-1α-2970 | CUAUUUAUAUUUUCUACAUCU | 1889 |
| HIF-1α-3055 | CUUAAUUUACAUUAAUGCUCU | 1900 |
| HIF-1α-3088 | UCUUUAAUGCUGGAUCACAGA | 1906 |
| HIF-1α-3110 | AGCUCAUUUUCUCAGUUUUUU | 1908 |
| HIF-1α-3310 | CCUUUUUUUUCACAUUUUACA | 1923 |
| HIF-1α-3448 | GAAGAAAUUUUUUUUGGCCUA | 1936 |
| HIF-1α-3450 | AGAAAUUUUUUUUGGCCUAUG | 1937 |
| HIF-1α-3598 | UAUGUGGCAUUUAUUUGGAUA | 1946 |
| HIF-1α-3616 | AUAAAAUUCUCAAUUCAGAGA | 1956 |
| HIF-1α-3646 | AUGUUUCUAUAGUCACUUUGC | 1958 |
| HIF-1α-3670 | CUCAAAAGAAAACAAUACCCU | 1960 |
| HIF-1α-3743 | UGUUCUGCCUACCCUGUUGGU | 1961 |
| HIF-1α-3791 | CAAGAAAAAAAAAAUCAUGCA | 1968 |
| HIF-1α-3861 | GAUUUUAUGCACUUUGUCGCU | 1970 |
| HIF-1α-3863 | UUUUAUGCACUUUGUCGCUAU | 1971 |
| HIF-1α-3880 | CUAUUAACAUCCUUUUUUUCA | 1979 |
| HIF-1α-3961 | AGUAAAUAUCUUGUUUUUUCU | 1988 |
| HIF-1α-4003 | CAUUCCUUUUGCUCUUUGUGG | 1993 |
| HIF-1α-4004 | AUUCCUUUUGCUCUUUGUGGU | 1994 |
| HIF-1α-4005 | UUCCUUUUGCUCUUUGUGGUU | 1995 |
| HIF-1α-4006 | UCCUUUUGCUCUUUGUGGUUG | 1996 |
| HIF-1α-4007 | CCUUUUGCUCUUUGUGGUUGG | 1997 |

TABLE 11

HIF-1α mRNA 21 Nucleotide Target Sequences of Additional Selected dsRNAs

| Human HIF-1α Target Location, Transcript Variant 1 | 21 Nucleotide Target Sequence | SEQ ID NO: |
|---|---|---|
| HIF-1α-403 | GUGAAGACAUCGCGGGGACCG | 1656 |
| HIF-1α-530 | UCUGAAGUUUUUAUGAGCUU | 1668 |
| HIF-1α-691 | GAUGAAUUGCUUUUAUUUGAA | 1684 |
| HIF-1α-713 | GCCUUGGAUGGUUUUGUUAUG | 1687 |
| HIF-1α-717 | UGGAUGGUUUUGUUAUGGUUC | 1689 |
| HIF-1α-1041 | ACAGUAACCAACCUCAGUGUG | 1717 |
| HIF-1α-1268 | CAUGCUUUGGACUCUGAUCAU | 1749 |
| HIF-1α-1271 | GCUUUGGACUCUGAUCAUCUG | 1750 |
| HIF-1α-1343 | UACAGGAUGCUUGCCAAAGA | 1774 |
| HIF-1α-1476 | ACUUGAUUUUCUCCCUUCAAC | 1807 |
| HIF-1α-1648 | CACAAUCAUAUCUUUAGAUUU | 1814 |
| HIF-1α-1944 | GCACUAGACAAAGUUCACCUG | 1828 |
| HIF-1α-2034 | UGGUAGAAAAACUUUUUGCUG | 1832 |
| HIF-1α-2730 | AGCAAAAGACAAUUAUUUUAA | 1849 |

TABLE 11-continued

HIF-1α mRNA 21 Nucleotide Target Sequences of Additional Selected dsRNAs

| Human HIF-1α Target Location, Transcript Variant 1 | 21 Nucleotide Target Sequence | SEQ ID NO: |
| --- | --- | --- |
| HIF-1α-2925 | UUCAUUCCUUUUUUGGACAC | 1884 |
| HIF-1α-2963 | AAGCAGUCUAUUUAUAUUUUC | 1887 |
| HIF-1α-2963 | AAGCAGUCUAUUUAUAUUUUC | 1887 |
| HIF-1α-2965 | GCAGUCUAUUUAUAUUUUCUA | 1888 |
| HIF-1α-3055 | CUUAAUUUACAUUAAUGCUCU | 1900 |
| HIF-1α-3110 | AGCUCAUUUCUCAGUUUUUU | 1908 |
| HIF-1α-3310 | CCUUUUUUUCACAUUUUACA | 1923 |
| HIF-1α-3310 | CCUUUUUUUCACAUUUUACA | 1923 |
| HIF-1α-3374 | CACAAUAUAUUUCUUAAAAA | 1930 |
| HIF-1α-3448 | GAAGAAAUUUUUUUGGCCUA | 1936 |
| HIF-1α-3450 | AGAAAUUUUUUUGGCCUAUG | 1937 |
| HIF-1α-3616 | AUAAAAUUCUCAAUUCAGAGA | 1956 |
| HIF-1α-3670 | CUCAAAAGAAAACAAUACCCU | 1960 |
| HIF-1α-3743 | UGUUCUGCCUACCCUGUUGGU | 1961 |
| HIF-1α-3791 | CAAGAAAAAAAAAUCAUGCA | 1968 |
| HIF-1α-3880 | CUAUUAACAUCCUUUUUUUCA | 1979 |
| HIF-1α-3920 | GUAAUUUUAGAAGCAUUAUUU | 1982 |
| HIF-1α-3922 | AAUUUUAGAAGCAUUAUUUA | 1983 |
| HIF-1α-4003 | CAUUCCUUUUGCUCUUUGUGG | 1993 |
| HIF-1α-4004 | AUUCCUUUUGCUCUUUGUGGU | 1994 |
| HIF-1α-4005 | UUCCUUUUGCUCUUUGUGGUU | 1995 |
| HIF-1α-4006 | UCCUUUUGCUCUUUGUGGUUG | 1996 |
| HIF-1α-4007 | CCUUUUGCUCUUUGUGGUUGG | 1997 |
| HIF-1α-4008 | CUUUUGCUCUUUGUGGUUGGA | 1998 |
| HIF-1α-4009 | UUUUGCUCUUUGUGGUUGGAU | 1999 |
| HIF-1α-4010 | UUUGCUCUUUGUGGUUGGAUC | 2000 |
| HIF-1α-4012 | UGCUCUUUGUGGUUGGAUCUA | 2001 |

TABLE 12

HIF-1α mRNA 21 Nucleotide Target Sequences of Further Selected dsRNAs

| Human HIF-1α Target Location, Transcript Variant 1 | 21 Nucleotide Target Sequence | SEQ ID NO: |
| --- | --- | --- |
| HIF-1α-403 | GUGAAGACAUCGCGGGGACCG | 1656 |
| HIF-1α-3448 | GAAGAAAUUUUUUUGGCCUA | 1936 |
| HIF-1α-3791 | CAAGAAAAAAAAAUCAUGCA | 1968 |
| HIF-1α-3880 | CUAUUAACAUCCUUUUUUUCA | 1979 |
| HIF-1α-4003 | CAUUCCUUUUGCUCUUUGUGG | 1993 |
| HIF-1α-4004 | AUUCCUUUUGCUCUUUGUGGU | 1994 |
| HIF-1α-4005 | UUCCUUUUGCUCUUUGUGGUU | 1995 |
| HIF-1α-4006 | UCCUUUUGCUCUUUGUGGUUG | 1996 |
| HIF-1α-4007 | CCUUUUGCUCUUUGUGGUUGG | 1997 |

Example 3

Figure 3C:
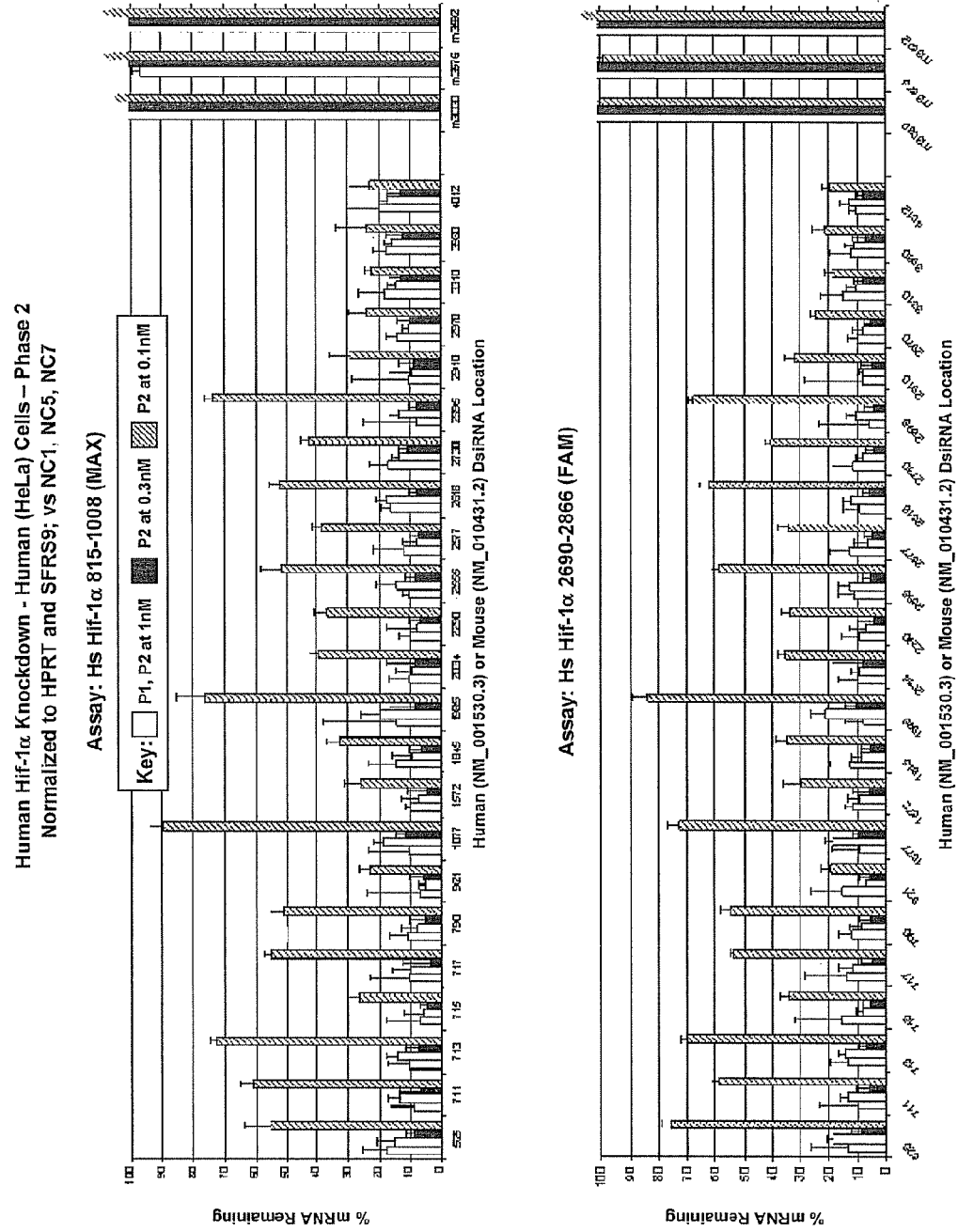
Figure 3D:
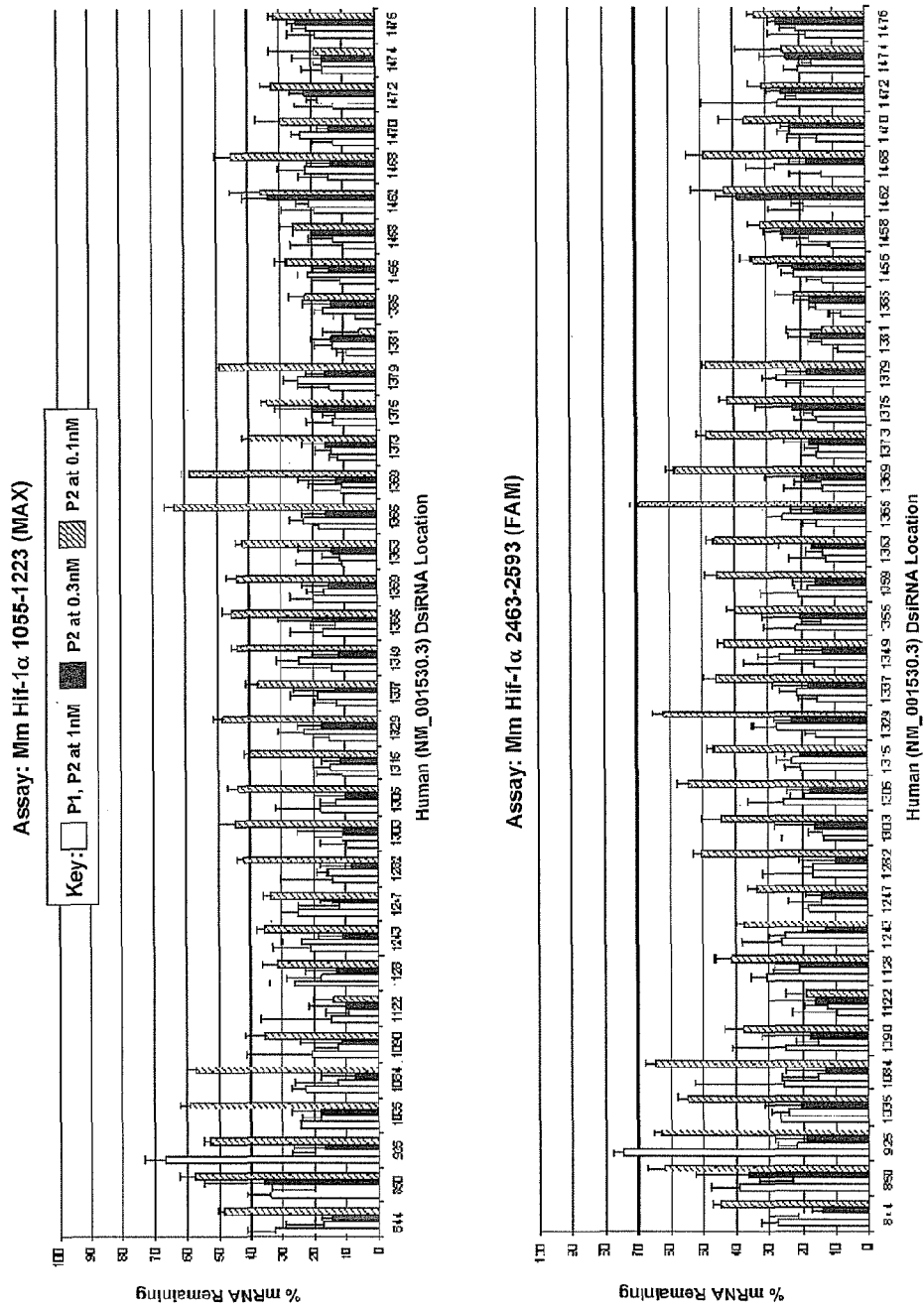
Figure 3E:
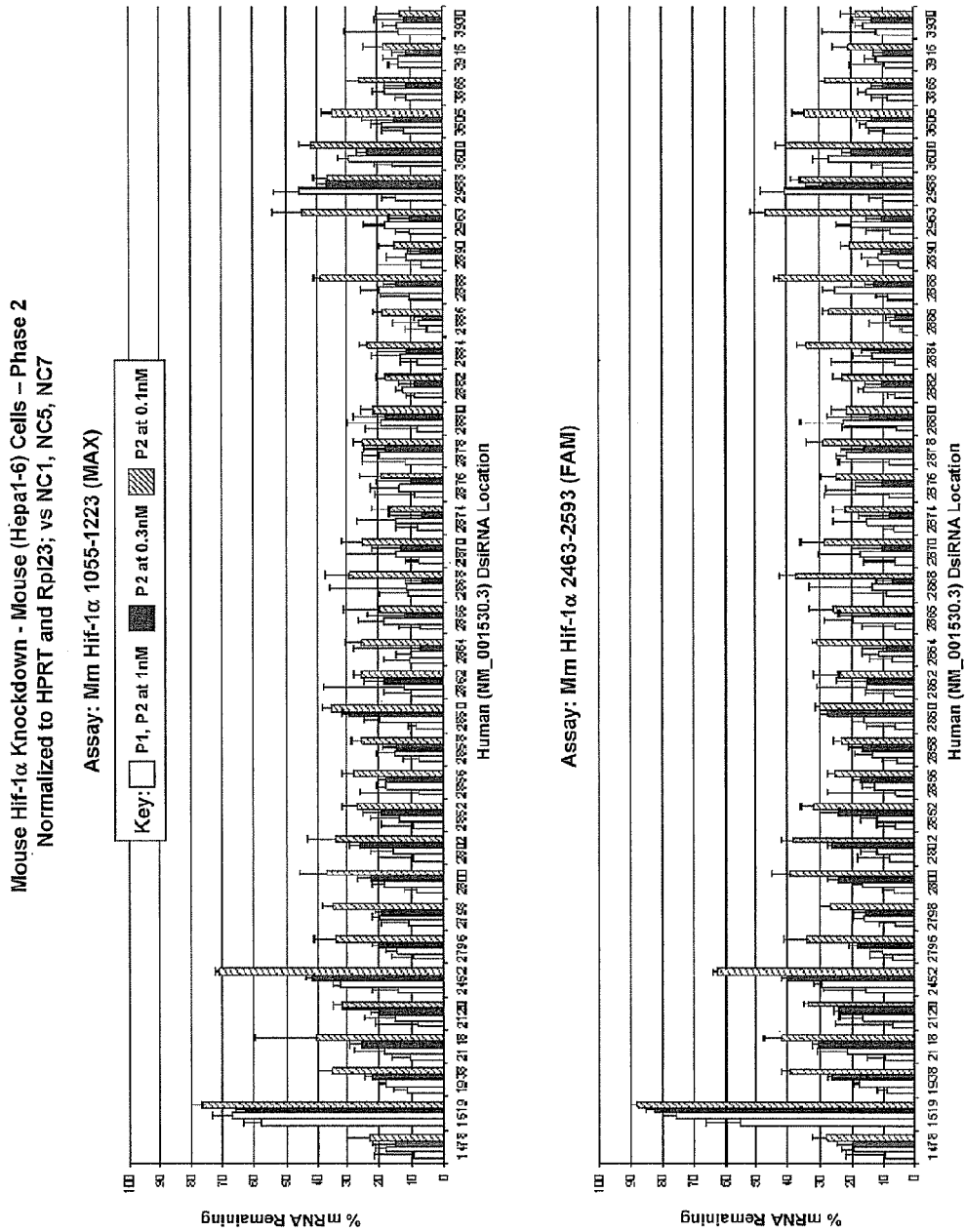
Figure 3F:
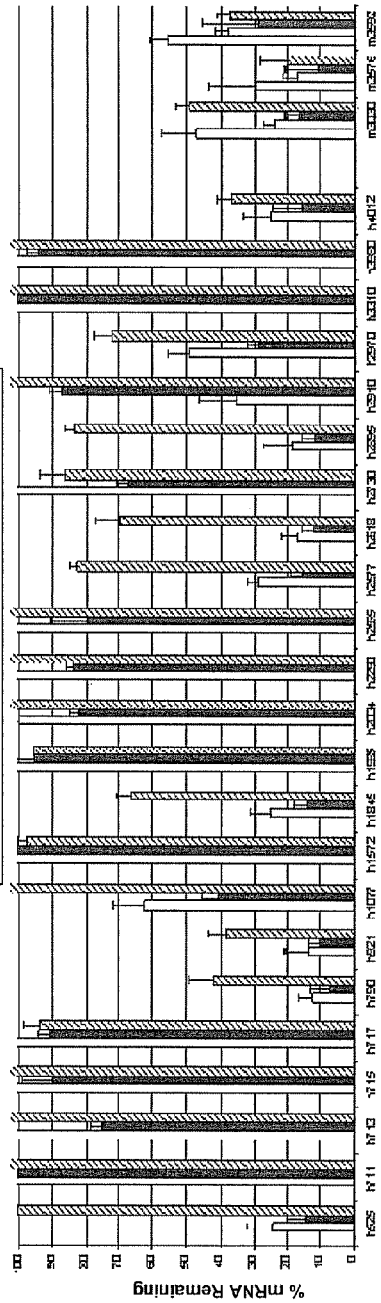
Figure 3F:
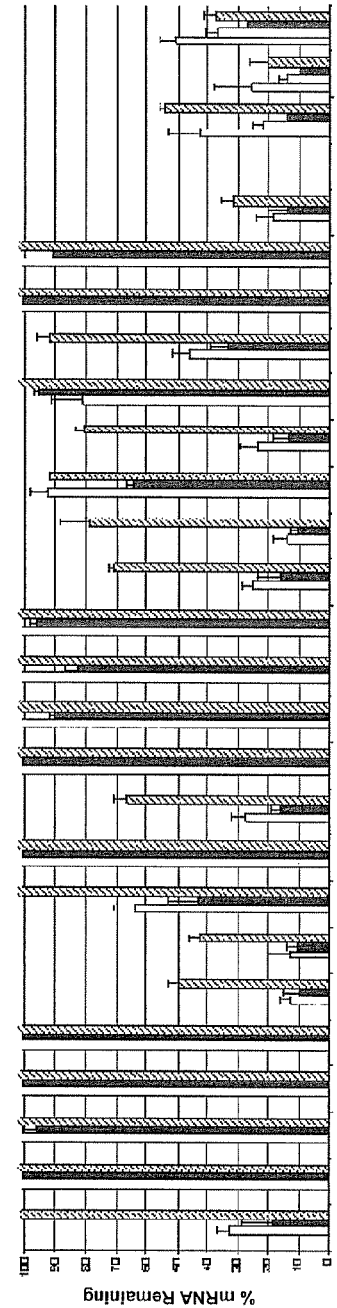

DsiRNA Inhibition of HIF-1α—Secondary Screen 96 asymmetric DsiRNAs of the above experiment were then examined in a secondary assay ("Phase 2"), with results of such assays presented in histogram form in FIGS. 3A-3F. Specifically, the 96 asymmetric DsiRNAs selected from the 450 tested above were assessed for inhibition of human HIF-1α at 1 nM, 0.3 nM and 0.1 nM in the environment of human HeLa cells (FIGS. 3A-3C). These 96 asymmetric DsiRNAs were also assessed for inhibition of mouse HIF-1α at 1 nM, 0.3 nM and 0.1 nM in the environment of mouse HEPA1-6 cells (FIGS. 3D-3F). As shown in FIGS. 3A-3C, a remarkable number of asymmetric DsiRNAs reproducibly exhibited robust human HIF-1α inhibitory efficacies at sub-nanomolar concentrations when assayed in the environment of HeLa cells. In addition, as shown in FIGS. 3D-3F, a number of these asymmetric DsiRNAs also showed robust mouse HIF-1α inhibitory efficacies at 1 nM, 300 pM and 100 pM when assayed in the environment of mouse HEPA1-6 cells. (Meanwhile, both human HIF-1α-specific and mouse HIF-1α-specific inhibitory asymmetric DsiRNAs were also identified).

Example 4

Inhibition of HIF-1α by Additional Preferred DsiRNAs

Remaining DsiRNA molecules shown in Tables 3 and 6-7 above possessing sense and antisense strand sequences as shown and targeting HIF-1α wild-type sequences (and variant sequences where applicable) are designed and synthesized as described above and tested in HeLa cells (and, optionally, in mouse HEPA1-6 cells) for inhibitory efficacy as described in Examples 2 and 3 above. The ability of these DsiRNA agents to inhibit HIF-1α expression is optionally assessed in comparison to corresponding HIF-1α target sequence-directed 21mer siRNAs (21 nucleotide target sequences of HIF-1α dsRNA agents described herein are presented in Table 5 above). A significant number of the remaining selected DsiRNA agents of Tables 3 and 6-7 above are predicted to show efficacy as HIF-1α inhibitors, and are tested at 1 nM, 300 pM and at 100 pM concentrations in the environment of a cell. These additional DsiRNAs and the DsiRNAs tested herein are also examined for the ability to outperform cognate siRNAs, as determined via measurement of efficacy in decreasing levels of HIF-1α target relative to a cognate 21mer siRNA agent. The duration of such inhibitory effects is also examined at both 24 hours and 48 hours post-administration, with concentrations of 0.1 nM, 0.3 nM, 1 nM and 5 nM tested. DsiRNAs of the instant invention are thereby examined for the ability to outperform their cognate 21mer siRNA, as determined via measurement of potency and/or duration of effect.

Example 5

Modified Forms of HIF-1α-Targeting DsiRNAs Reduced HIF-1α Levels In Vitro

Figure 4A:
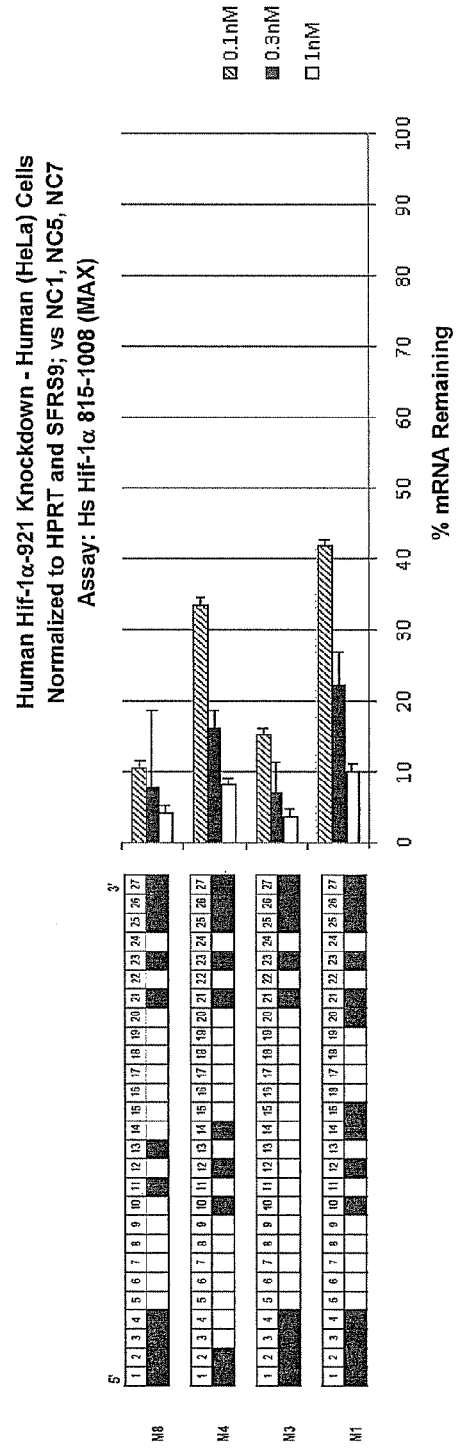
FIGS. 4A to 4X present bar graphs showing efficacy data for four different 2'-O-methyl modification patterns ("M8", "M4", "M3" and "M1", respectively) each across 24 HIF-1α-targeting DsiRNAs in human HeLa cells at 0.1 nM, 0.3 nM and 1 nM.
Figure 4B:
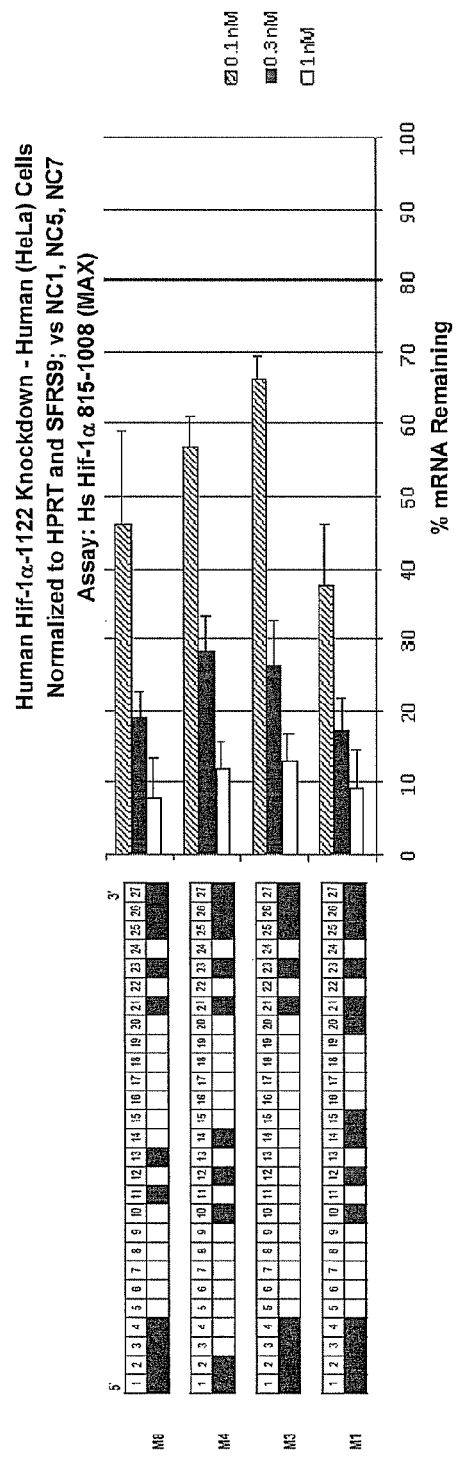
Figure 4C:
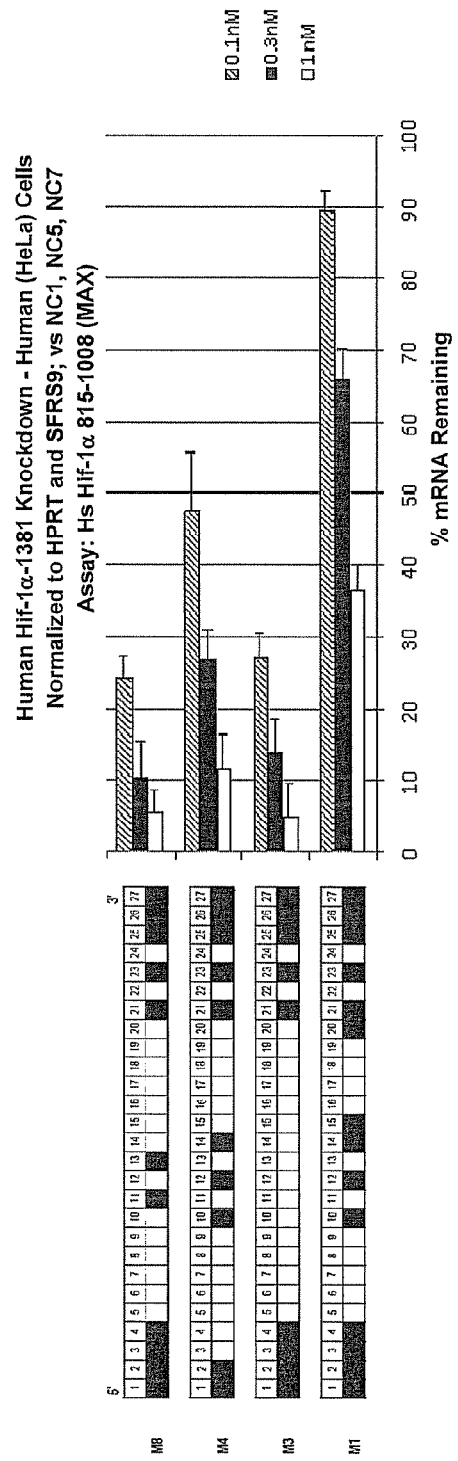
Figure 4D:
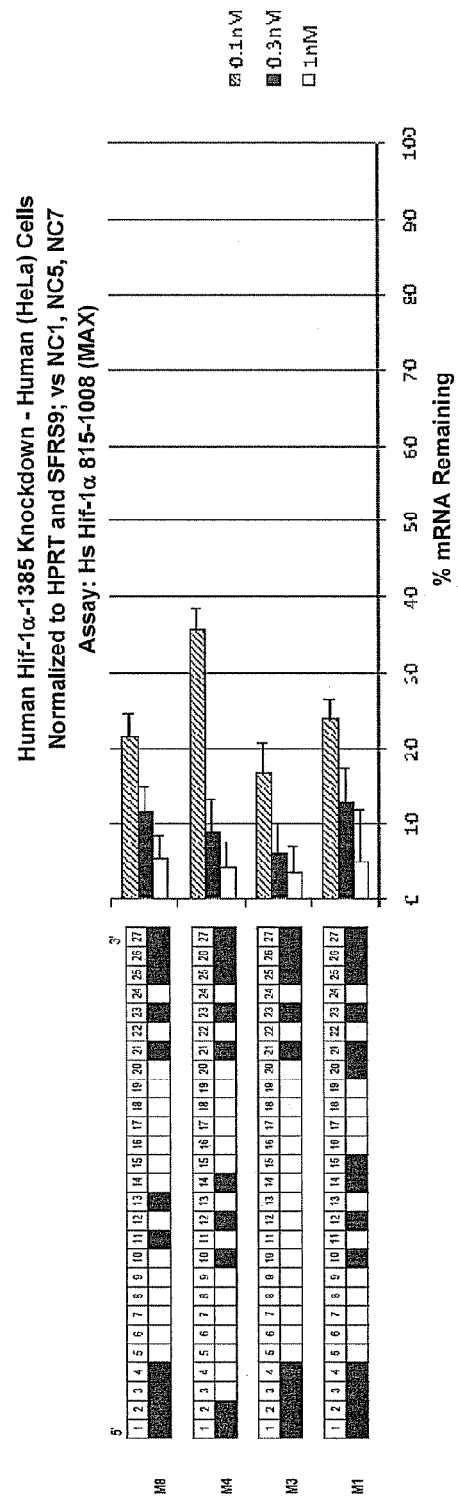
Figure 4E:
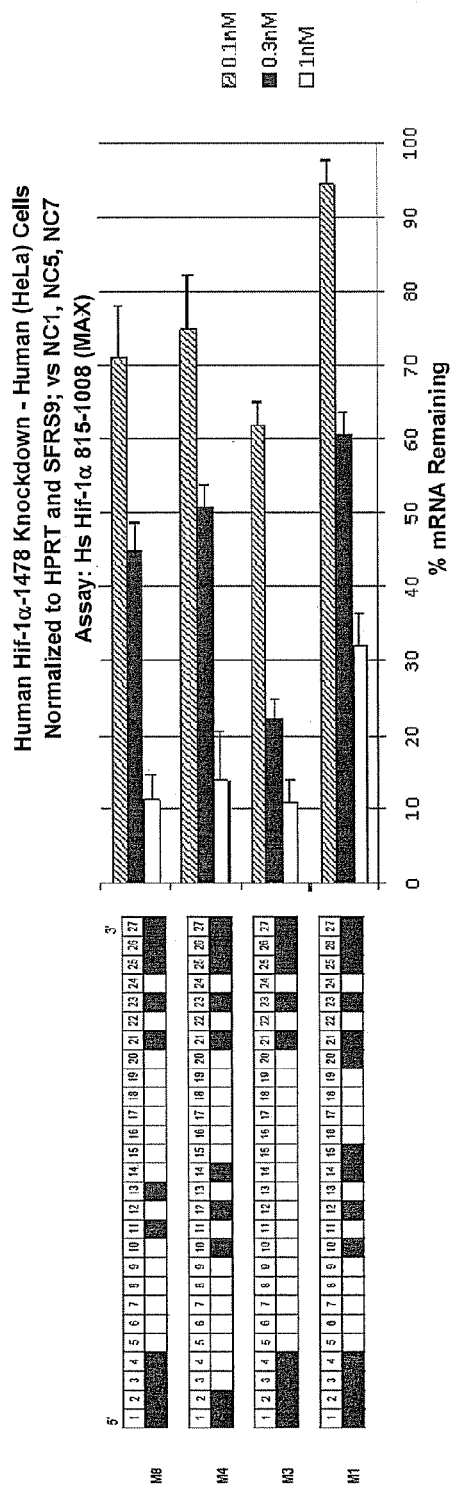
Figure 4F:
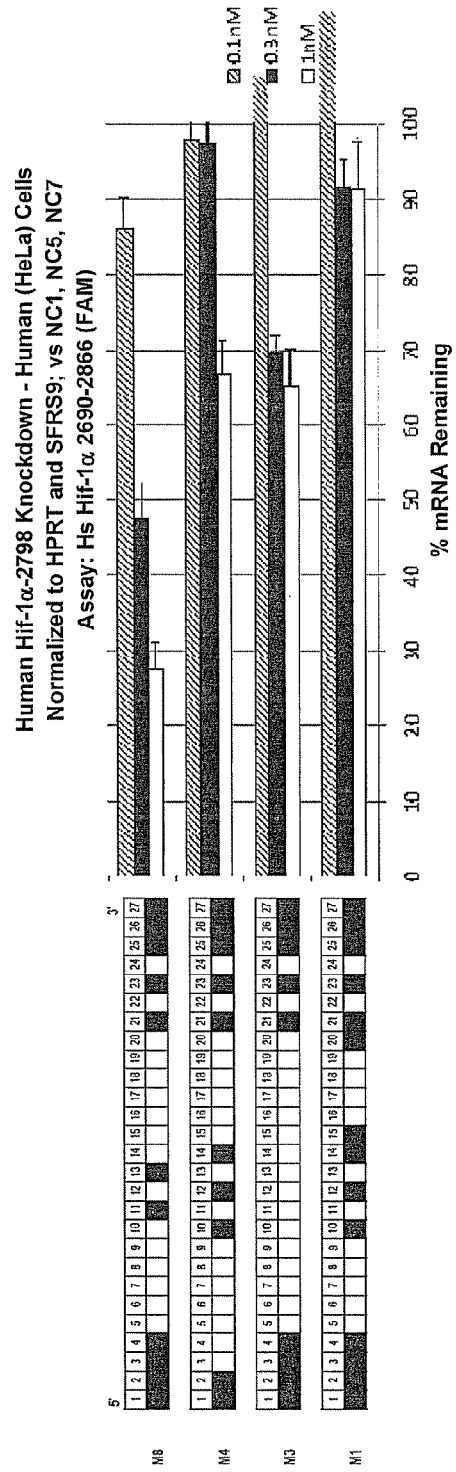
Figure 4G:
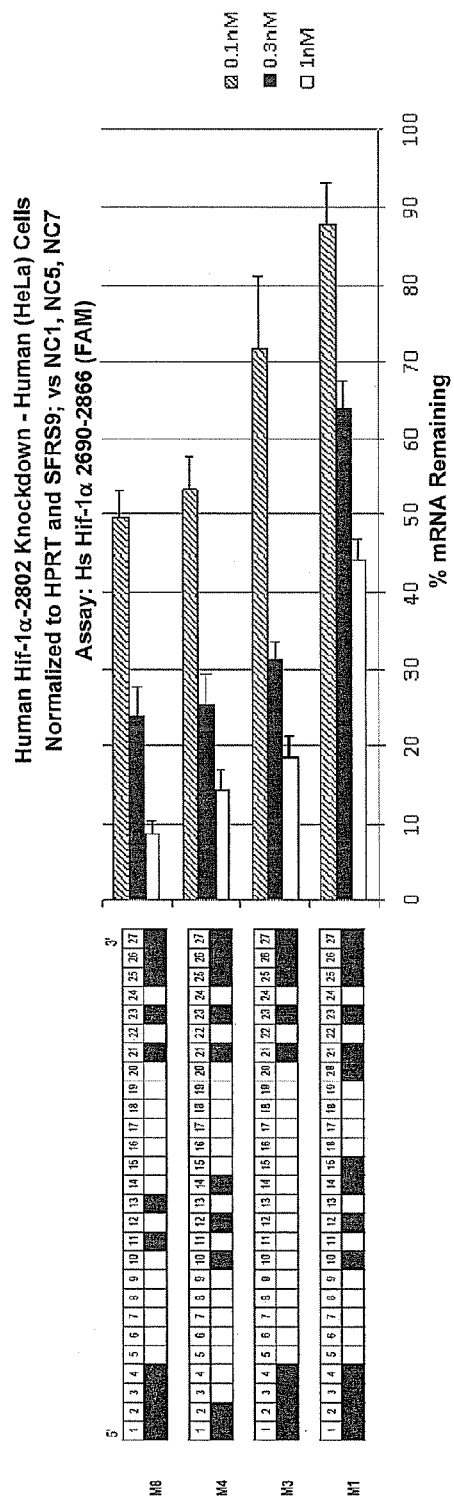
Figure 4H:
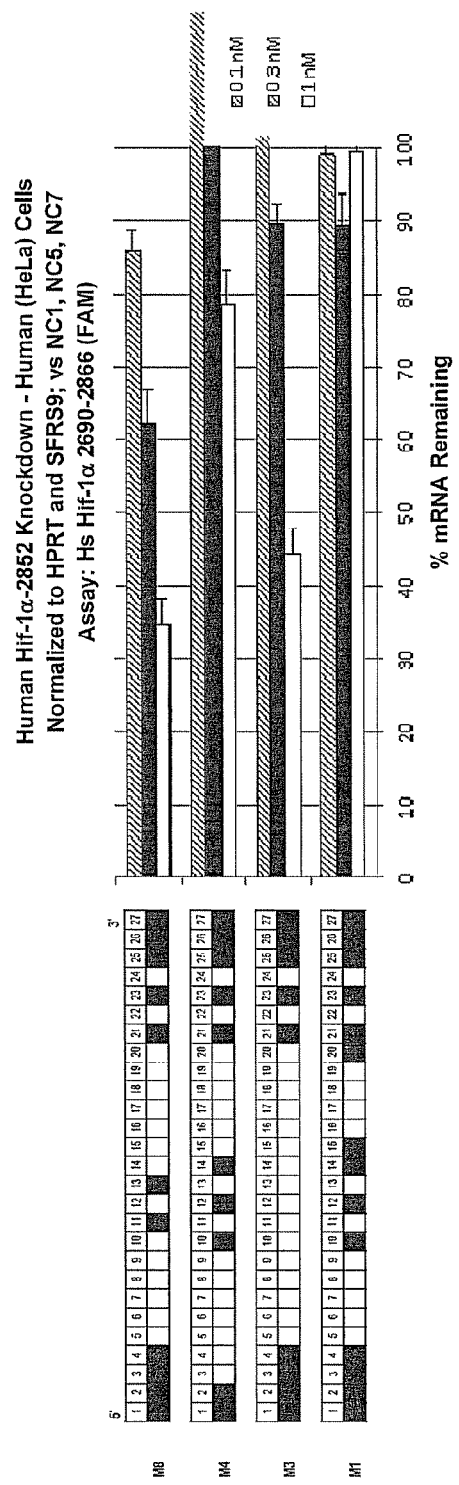
Figure 4I:
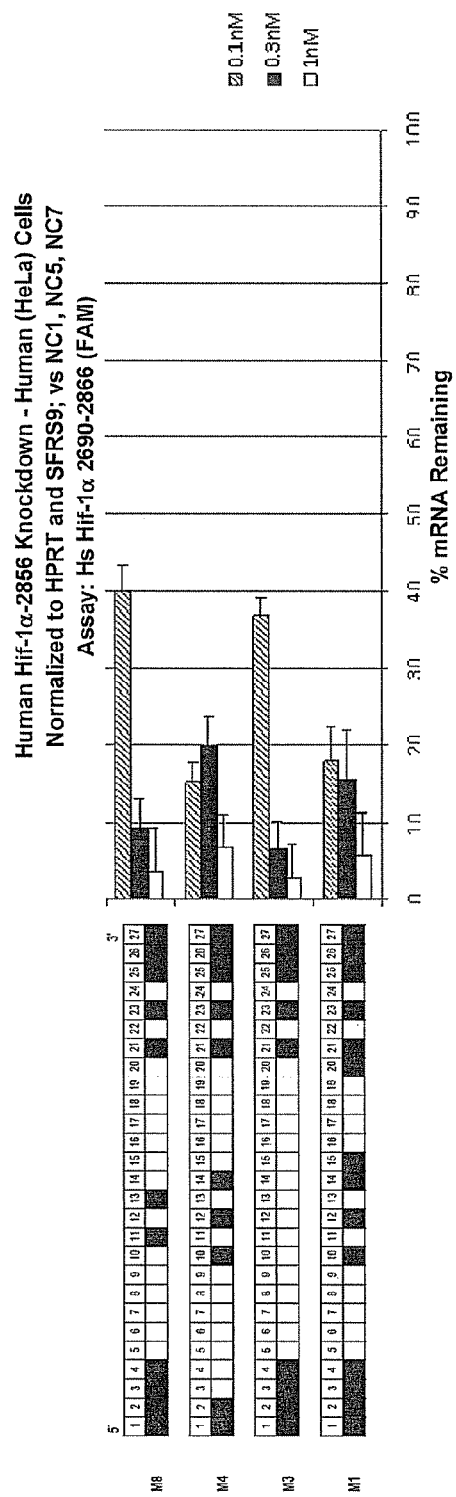
Figure 4J:
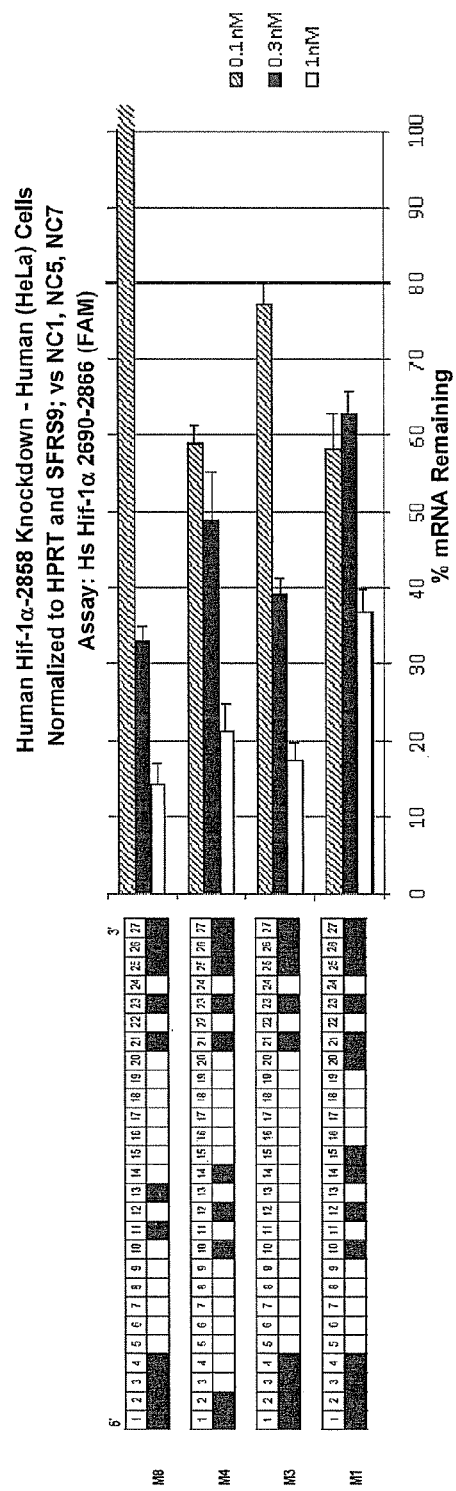
Figure 4K:
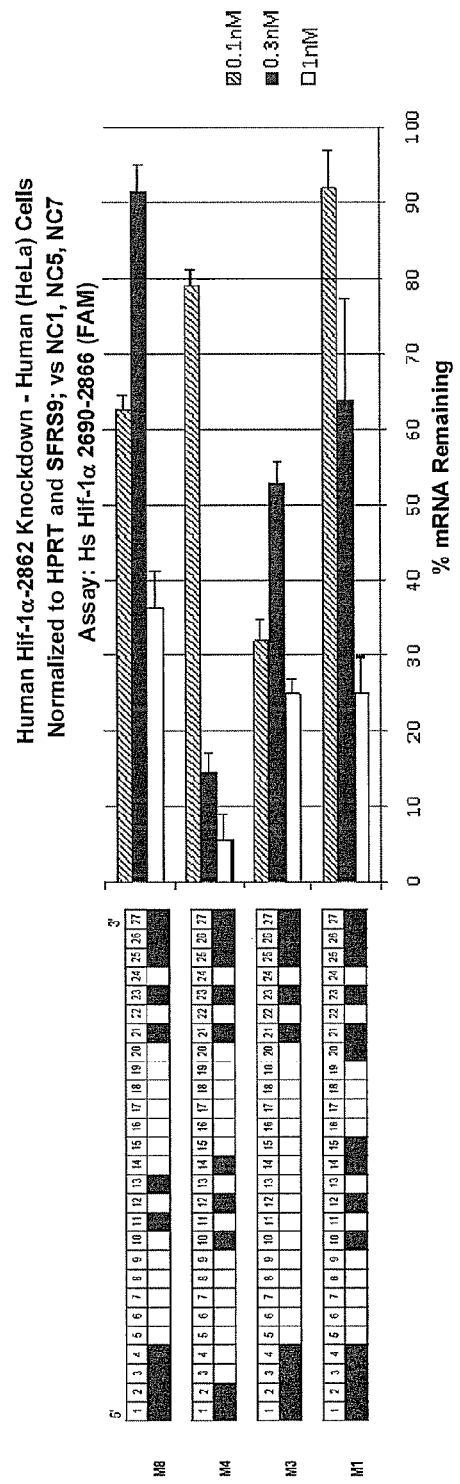
Figure 4L:
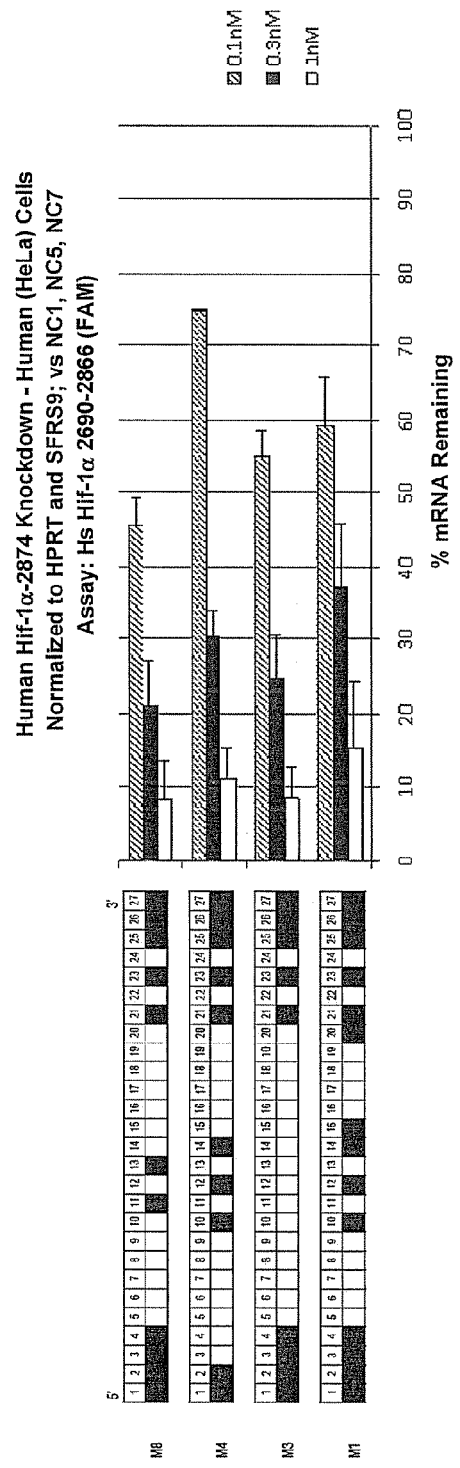
Figure 4M:
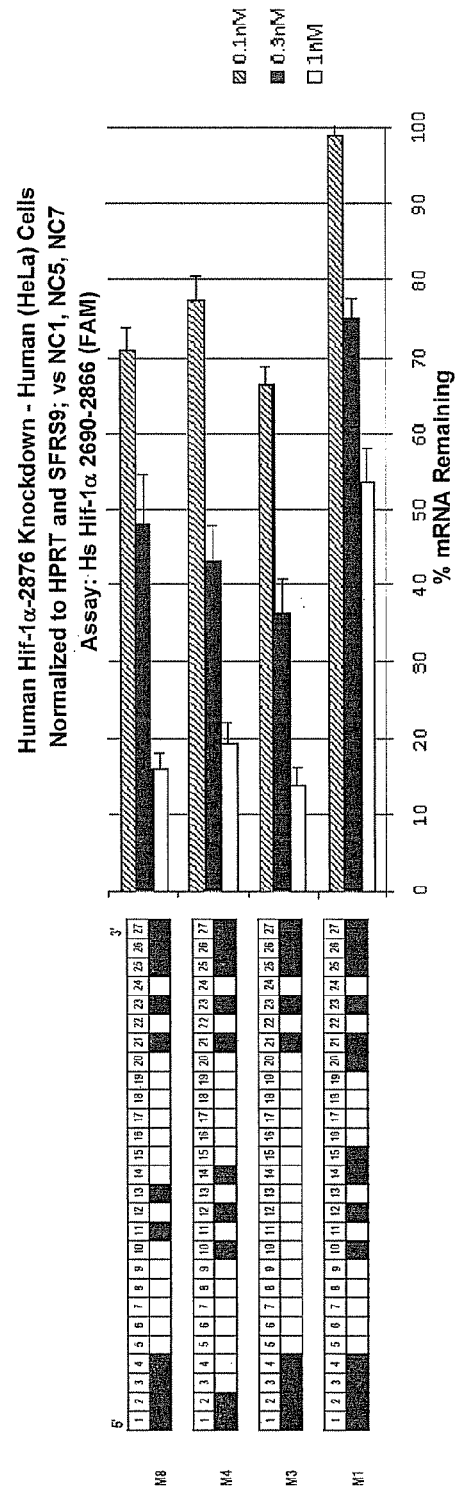
Figure 4N:
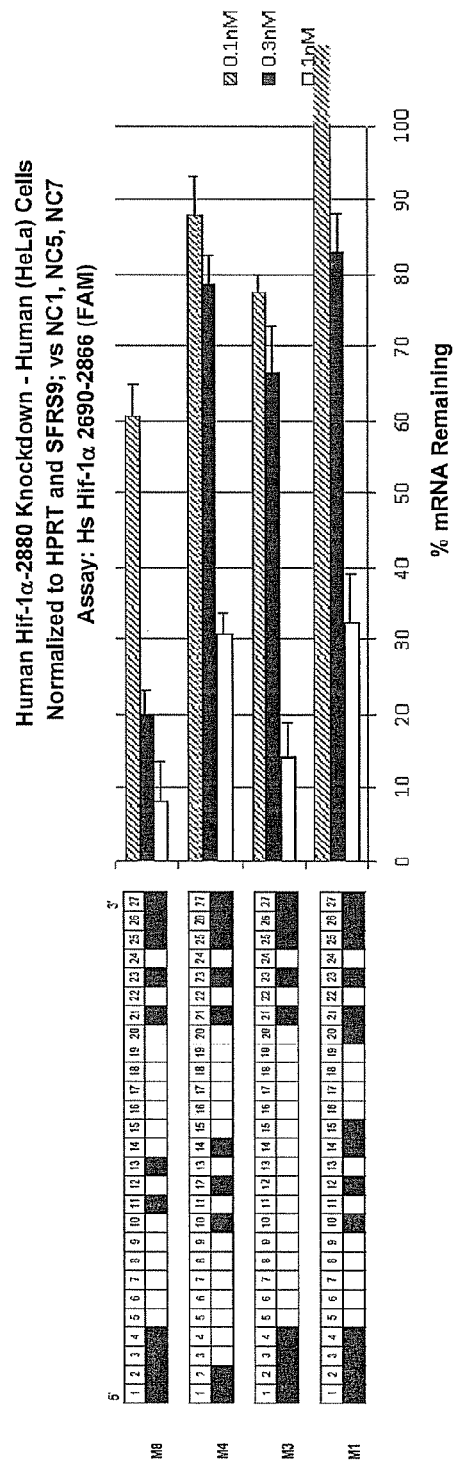
Figure 4O:
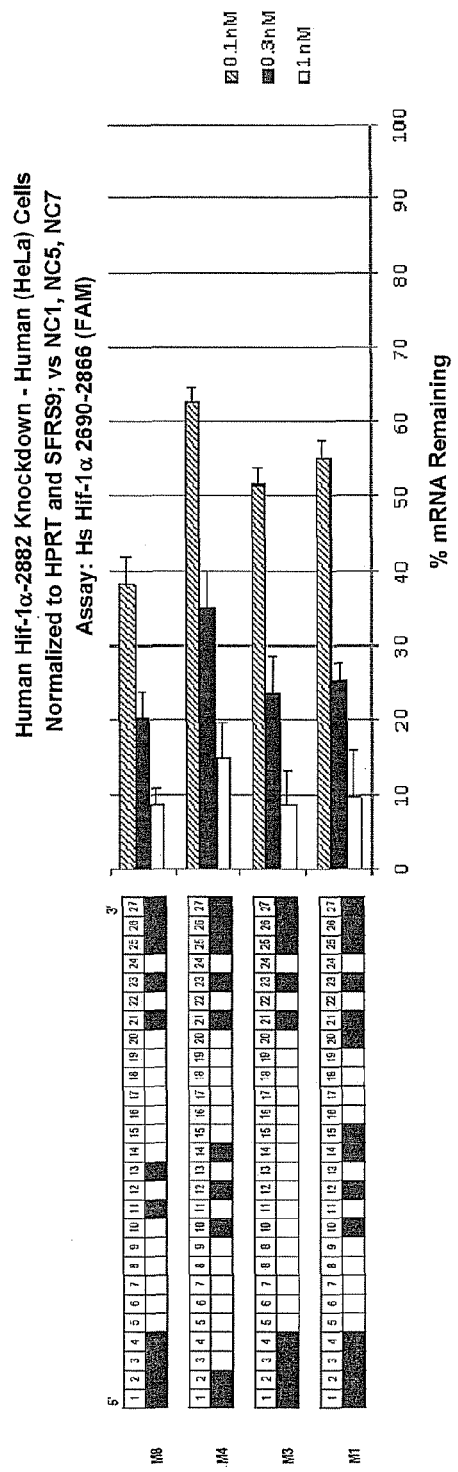
Figure 4P:
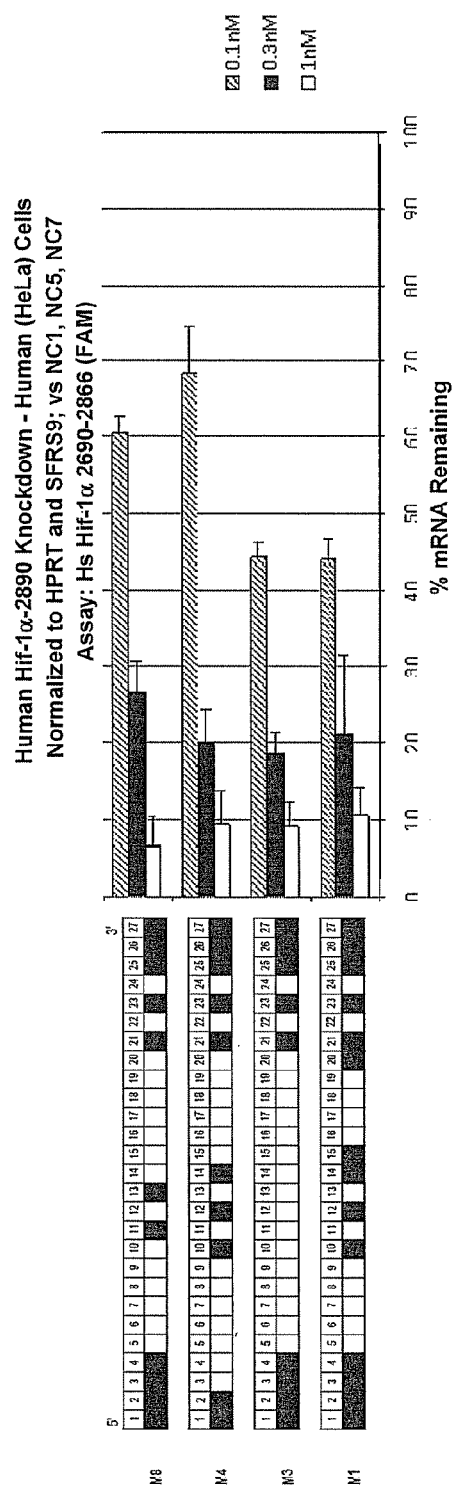
Figure 4Q:
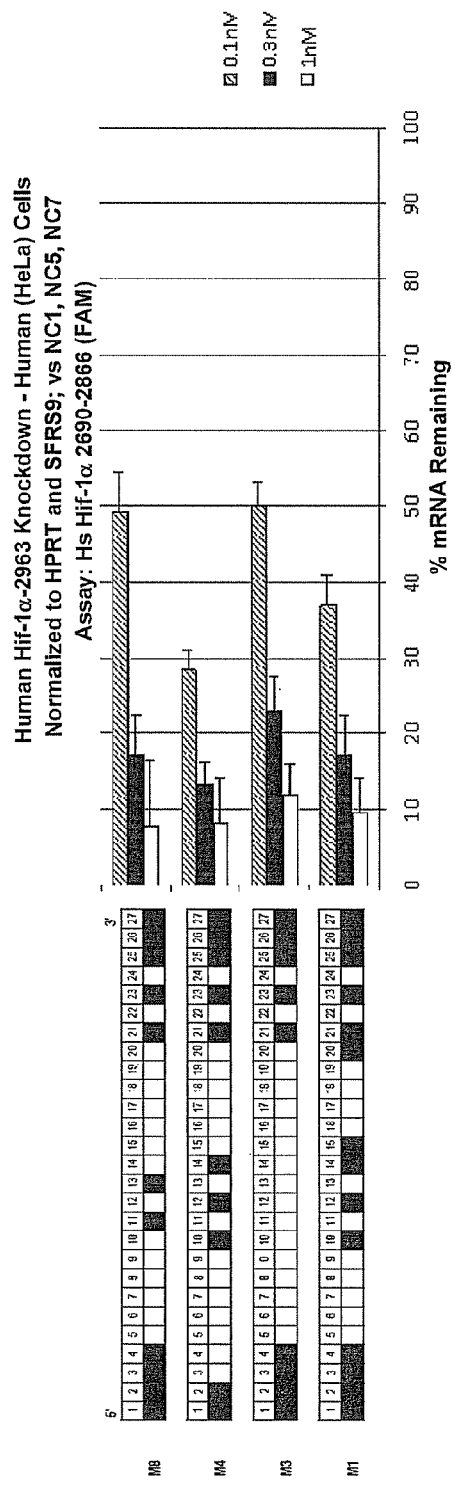
Figure 4R:
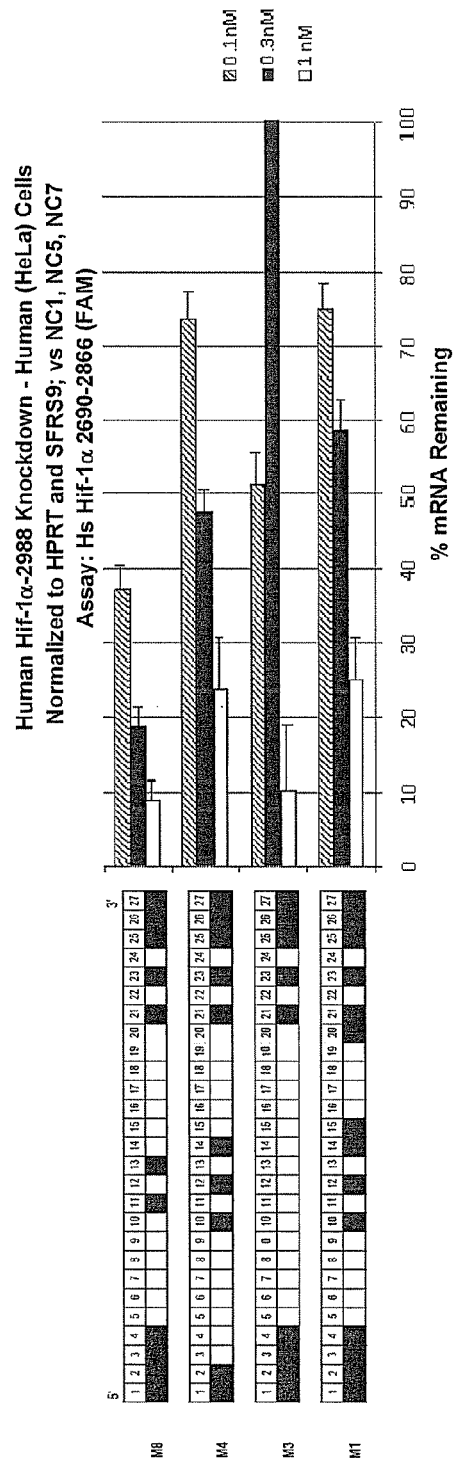
Figure 4S:
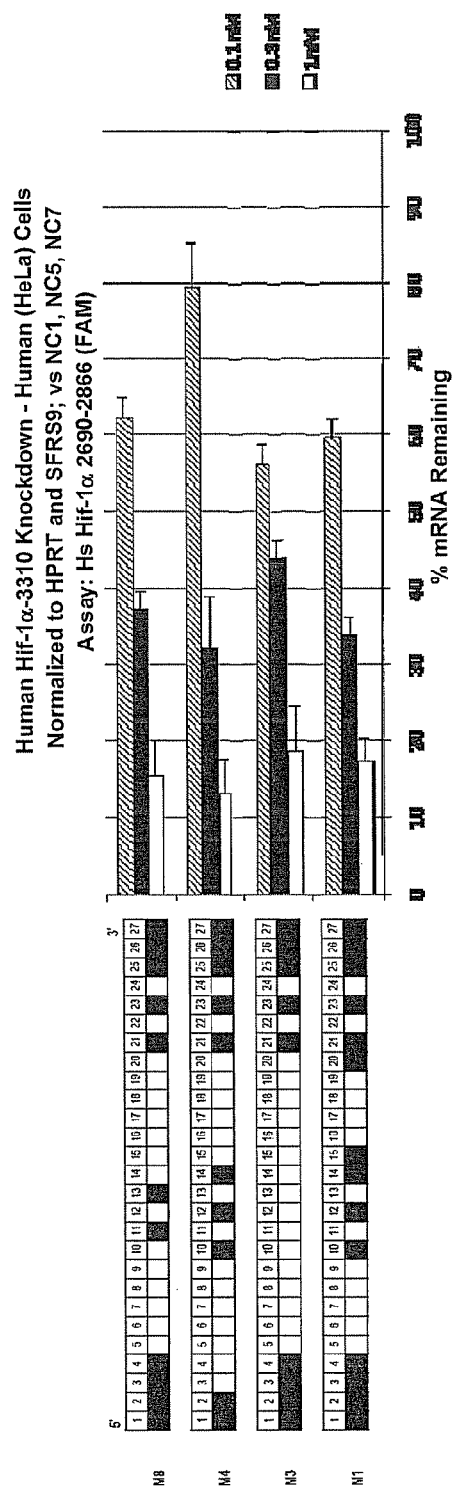
Figure 4T:
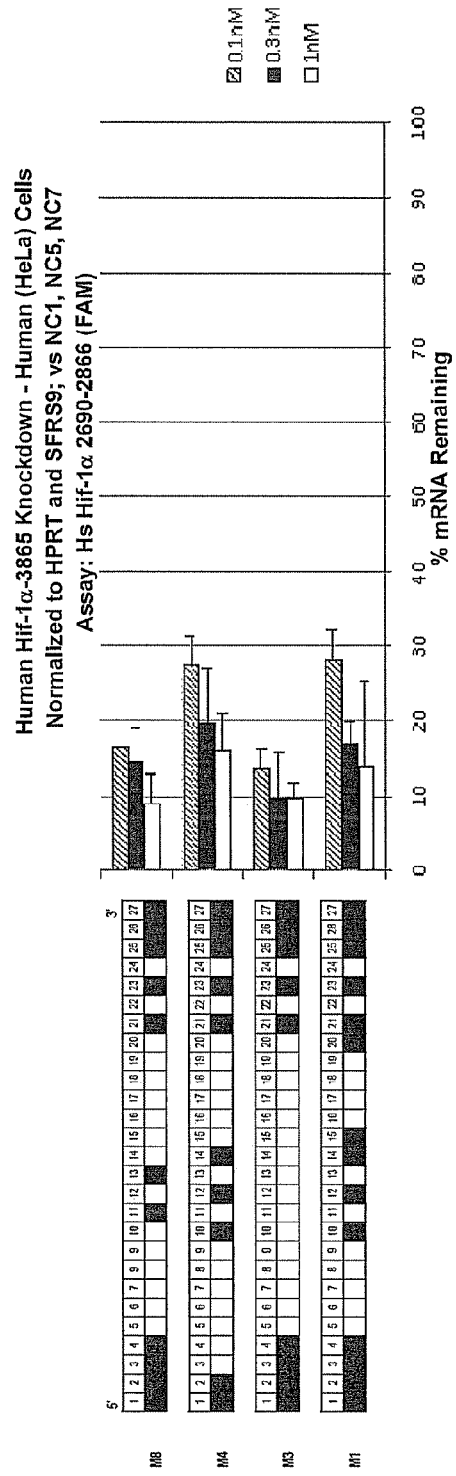
Figure 4U:
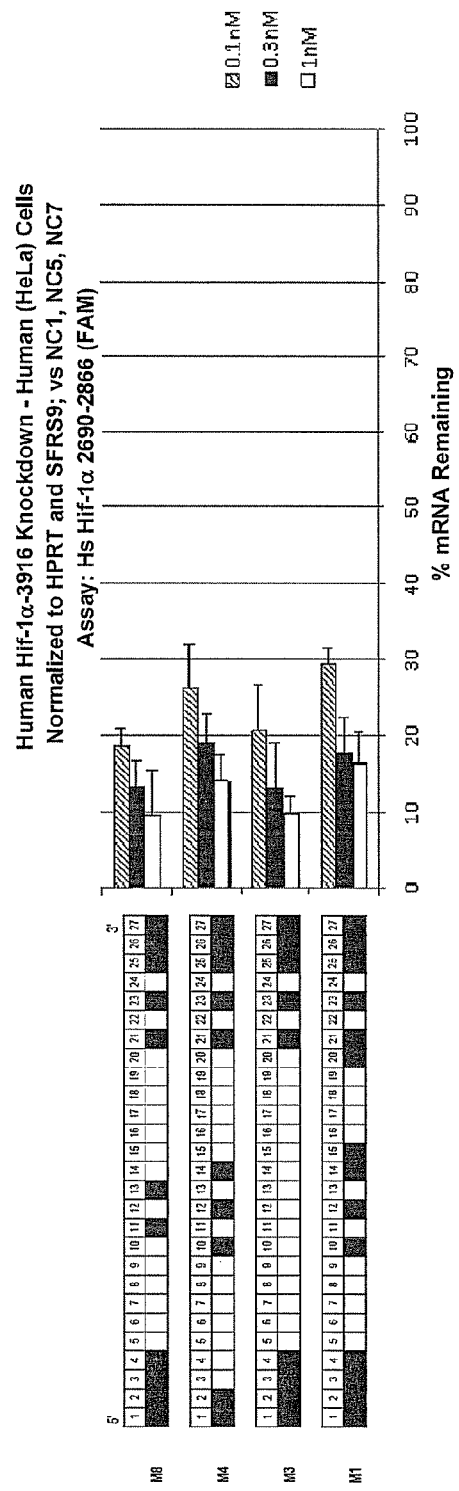
Figure 4V:
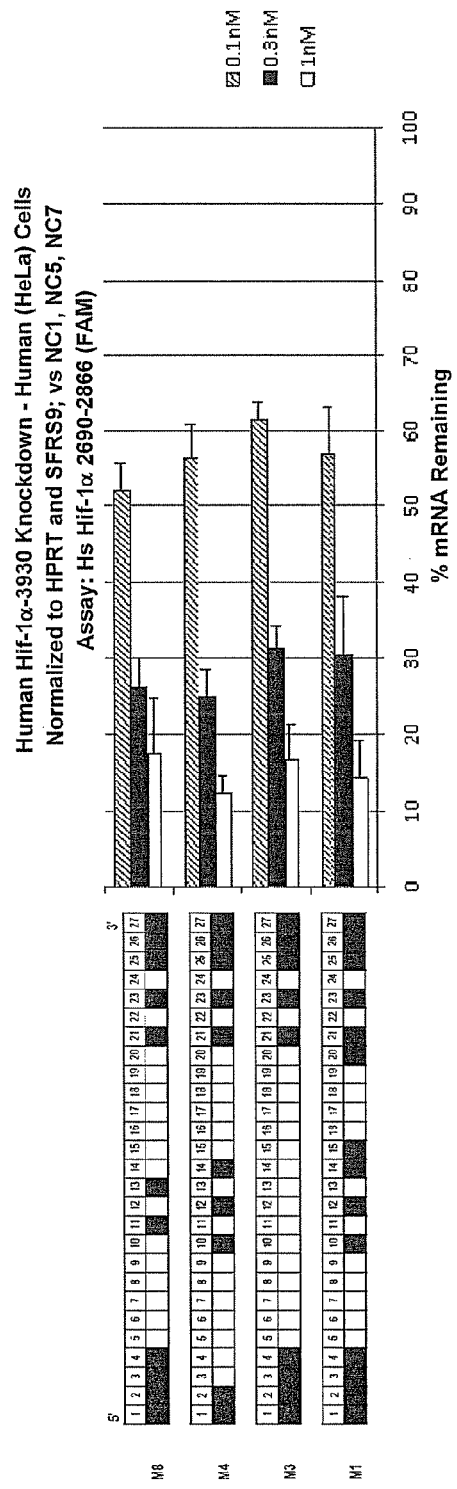
Figure 4W:
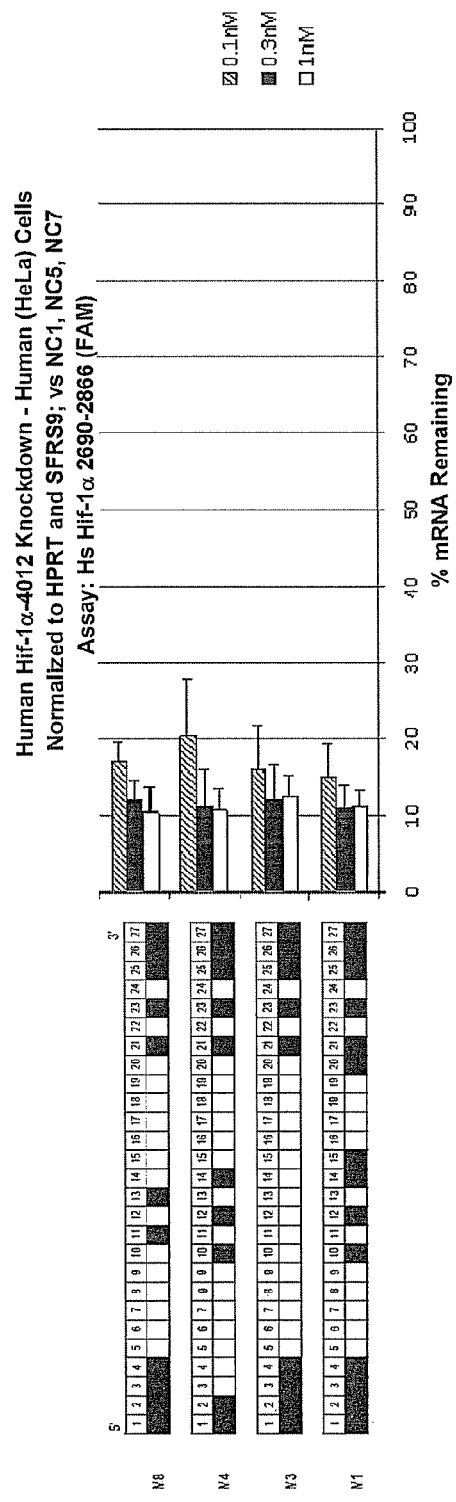
Figure 4X:
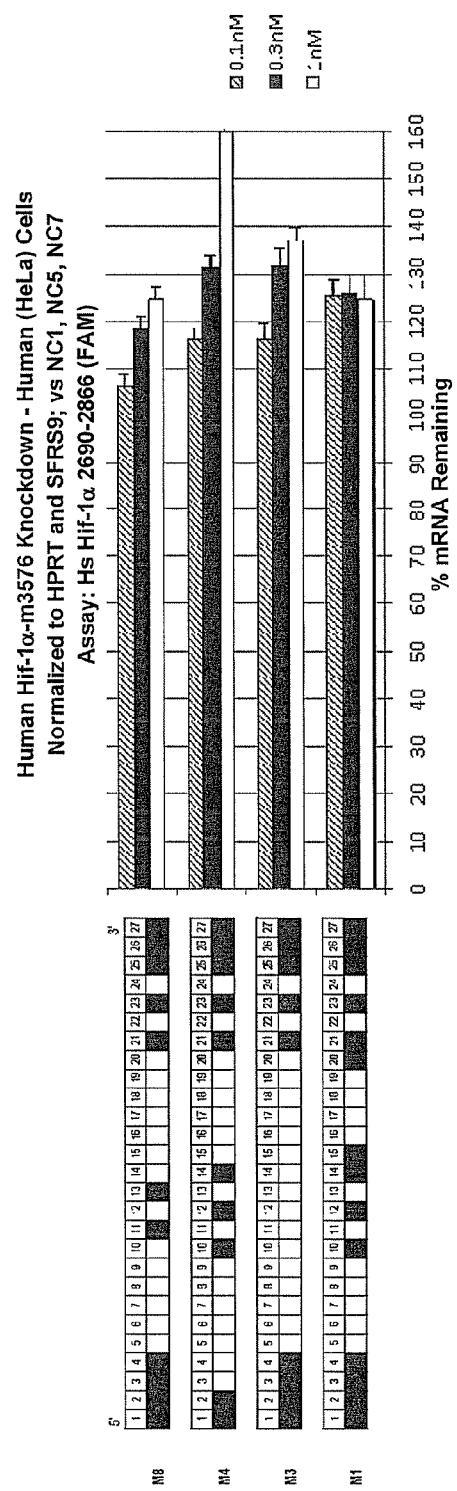

24 HIF-1α-targeting DsiRNAs (HIF-1α-921, HIF-1α-1122, HIF-1α-1381, HIF-1α-1385, HIF-1α-1478, HIF-1α-2798, HIF-1α-2802, HIF-1α-2852, HIF-1α-2856, HIF-1α-2858, HIF-1α-2862, HIF-1α-2874, HIF-1α-2876, HIF-1α-2880, HIF-1α-2882, HIF-1α-2890, HIF-1α-2963, HIF-1α-2988, HIF-1α-3310, HIF-1α-3865, HIF-1α-3916, HIF-1α-3930, HIF-1α-4012 and HIF-1α-m3576) were prepared with 2'-O-methyl modification patterns as shown in schematics of FIGS. 4A to 4X. For each of the 24 DsiRNA sequences, DsiRNAs possessing each of the four modification patterns were assayed for HIF-1α inhibition in human HeLa cells at 0.1 nM (in parallel assays) and 1.0 nM concentrations in the environment of the HeLa cells. Results of these experiments are presented as histograms in FIGS. 4A to 4X. In general, the 24 DsiRNA sequences exhibited a trend towards reduced efficacy of HIF-1α inhibition as the extent of 2'-O-methyl modification of the guide strand increased. However, for almost all DsiRNA sequences examined a modification pattern could be identified that allowed the DsiRNA to retain significant HIF-1α inhibitory efficacy in vitro. It was also notable that many DsiRNAs (e.g., HIF-1α-921, HIF-1α-1122, HIF-1α-1385, HIF-1α-2856, HIF-1α-2882, HIF-1α-2890, HIF-1α-2963, HIF-1α-3865, HIF-1α-3916 and HIF-1α-4012) exhibited robust HIF-1α inhibitory efficacy in even the most highly modified states examined. These data indicated that modification strategies designed to stabilize such DsiRNAs and/or reduce immunogenicity of such DsiRNAs when therapeutically administered to a subject in vivo could be implemented while retaining knockdown activity.

Example 6

HIF-1α-Targeting DsiRNAs Reduced HIF-1α Protein Levels In Vitro

Figure 5:
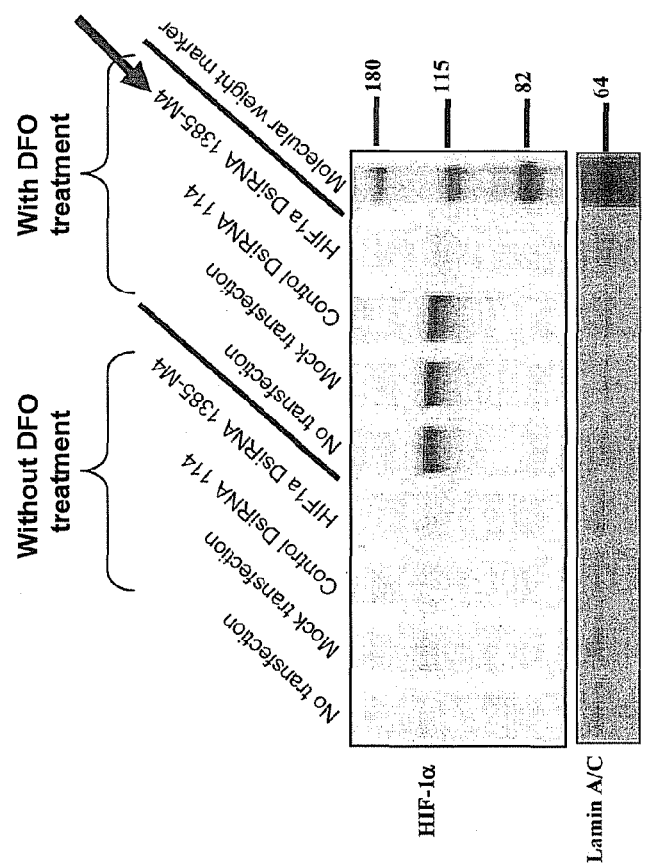
FIG. 5 shows that delivery of a HIF-1α-targeting DsiRNA (HIF-1α-1385, possessing 2'-O-methyl modification pattern "M4") to human HeLa cells effectively and dramatically reduced HIF-1α protein levels. DsiRNA transfection of HeLa cells occurred on day 0, with desferrioxamine (DFO) added to indicated HeLa cells on day 1 to induce HIF-1α expression. On day 2, HeLa cells were harvested and nuclear proteins were isolated for Western blot analysis. The Western blot of FIG. 5 was probed with anti-HIF-1α antibody (top panel), with Lamin A/C protein levels (bottom panel, resulting from probing the Western blot with anti-Lamin A/C antibody) shown for purpose of comparison to HIF-1α protein levels. "Control DsiRNA 114" indicates a non-specific, scrambled control DsiRNA.

The impact of a HIF-1α-targeting DsiRNA upon cellular protein levels was examined in vitro. Specifically, as shown in FIG. 5, delivery of HIF-1α-targeting DsiRNA, HIF-1α-1385 (here, possessing the 2'-O-methyl modification pattern referred to above as "M4") to human HeLa cells dramatically reduced HIF-1α protein levels. In such experiments, DsiRNA transfection of HeLa cells occurred on day 0 at 10 nM concentration, with desferrioxamine (DFO) added to indicated HeLa cells at 200 µM concentration on day 1 for purpose of inducing HIF-1α expression (as shown in the left-hand lanes of FIG. 5, such DFO treatment was necessary for detection of HIF-1α knockdown in the assayed cells). On day 2, HeLa cells were harvested and nuclear proteins were isolated for Western blot analysis (via use of a NE-PER™ Nuclear and Cytoplasmic Extraction Reagents kit from Thermo-Fisher Scientific™, Cat # PI78833)). The Western blot of FIG. 5 was probed with anti-HIF-1α antibody (top panel), with Lamin A/C protein levels (bottom panel, resulting from probing the Western blot with anti-Lamin A/C antibody) assayed for purpose of normalization of HIF-1α protein levels between samples. In FIG. 5, the "Control DsiRNA 114" was a non-specific, scrambled control DsiRNA. Notably, and as expected, the HIF-1α mRNA knockdown demonstrated for the HIF-1α-1385-M4 DsiRNA in FIG. 4D was shown to correlate directly with the significant knockdown of HIF-1α protein levels that was observed for the HIF-1α-1385-M4 DsiRNA in FIG. 5.

Example 7

Dose-Response of Seven Selected HIF-1α-Targeting DsiRNAs

Figure 6:
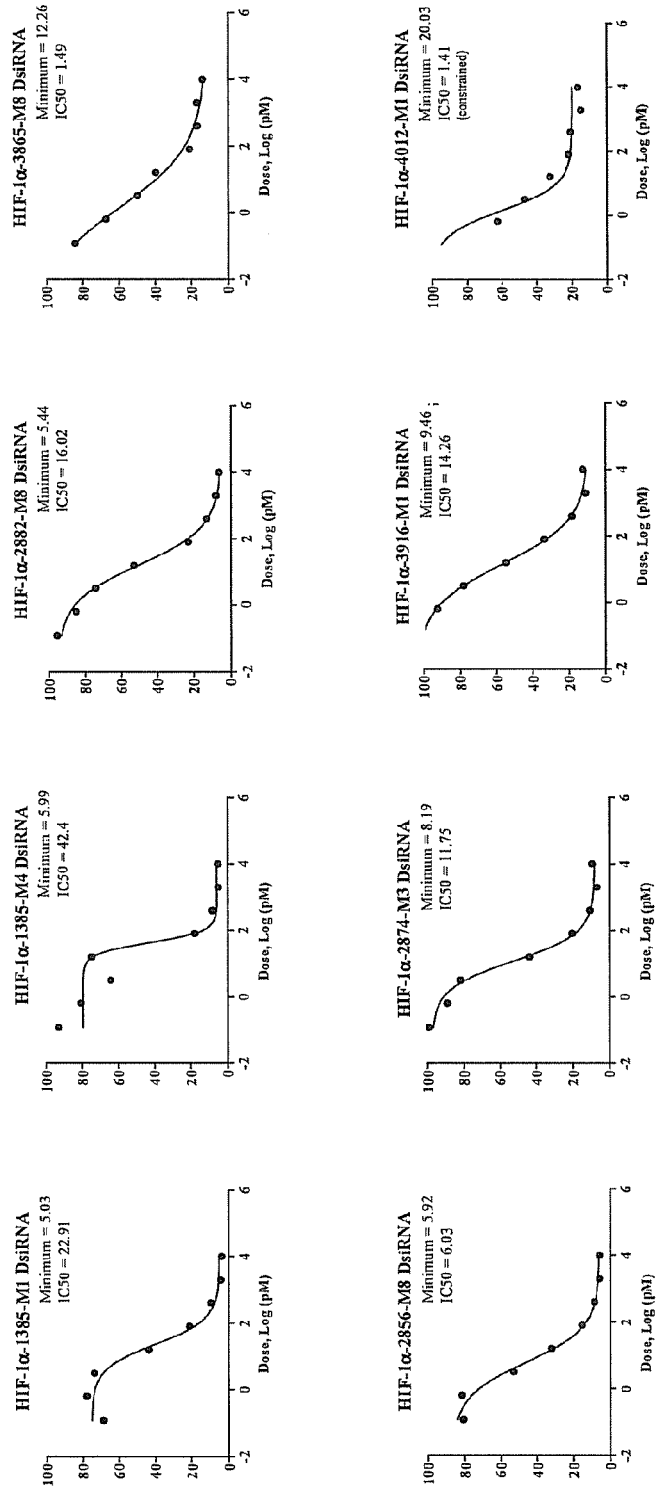
FIG. 6 shows HIF-1α inhibitory dose-response curves obtained for seven distinct HIF-1α-targeting DsiRNAs (two different modified forms of HIF-1α-1385 DsiRNAs were examined, in addition to single modified forms of each of six other DsiRNAs). $IC_{50}$ values observed for each DsiRNA were calculated for each dose-response curve and ranged from 1.41 pM (HIF-1α-4012, possessing 2'-O-methyl modification pattern "M1") to 42.1 pM (HIF-1α-1385, possessing 2'-O-methyl modification pattern "M4").

Seven different HIF-1α-targeting DsiRNAs (HIF-1α-2882, HIF-1α-3865, HIF-1α-2856, HIF-1α-2874, HIF-1α-3916, HIF-1α-4012 and HIF-1α-1385) were selected for assessment of dose-response characteristics in vitro in HeLa cells. Individual modified forms of HIF-1α-2882 (-M8), HIF-1α-3865 (-M8), HIF-1α-2856 (-M8), HIF-1α-2874 (-M3), HIF-1α-3916 (-M1) and HIF-1α-4012 (-M1) were assessed, while two distinct modified forms of HIF-1α-1385, HIF-1α-1385-M1 and HIF-1α-1385-M4, were assayed. As shown in FIG. 6, sub-nanomolar $IC_{50}$ values were observed for each DsiRNA, with specific values ranging from 1.41 pM (HIF-1α-4012-M1) to 42.1 pM (HIF-1α-1385-M4). Thus, HIF-1α-targeting DsiRNAs were further demonstrated to be remarkably potent and effective inhibitors of HIF-1α expression.

Example 8

Further DsiRNA Inhibition of HIF-1α

Figure 7:
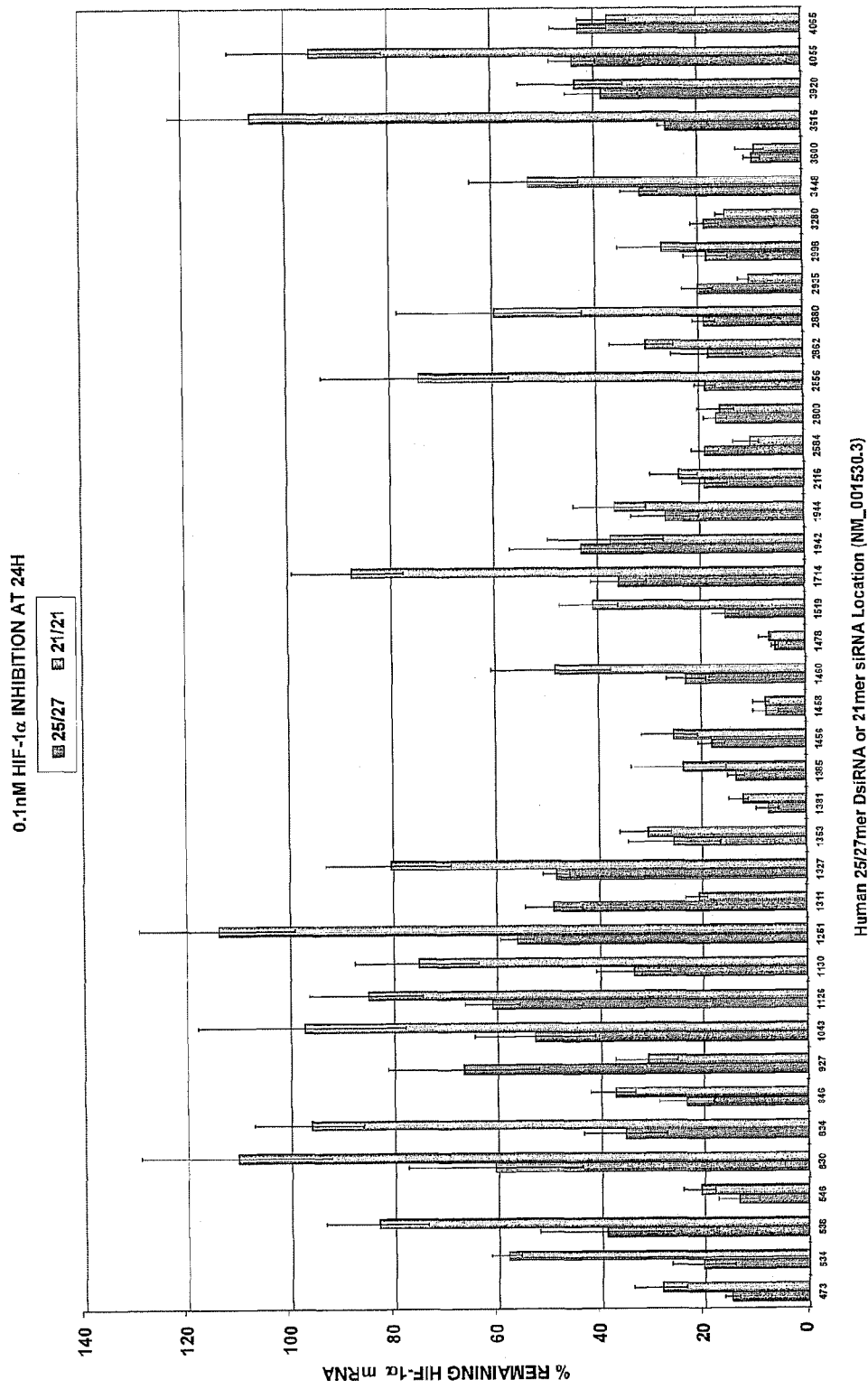
FIG. 7 demonstrates that a majority of assayed 25/27mer DsiRNAs were superior inhibitors of HIF-1α than corresponding 21mer siRNAs targeting the same HIF-1α sequence. Data were obtained via pairwise comparison of a set of forty HIF-1α-targeting 25/27mer DsiRNAs with corresponding 21mer siRNAs directed against the same 21 nucleotide HIF-1α target site. All agents (both 25/27mer DsiRNAs and 21mer siRNAs) were assayed at 0.1 nM concentration in the environment of HeLa cells in vitro. For 24 of the 40 tested anti-HIF-1α 25/27mer DsiRNA agents, statistically significant DsiRNA superiority was observed, as compared to only four of forty siRNA agents that outperformed DsiRNA agents.

Forty DsiRNA molecules selected from Table 2 above that target HIF-1α wild-type sequences were designed and synthesized as described above and tested in HeLa cells for inhibitory efficacy as described in Example 1 above. The ability of these DsiRNA agents to inhibit HIF-1α expression was assessed in comparison to corresponding HIF-1α target sequence-directed 21mer siRNAs (tested anti-HIF-1α 21mer agents were designed with antisense strands complementary to the 21 nucleotide target sequences as shown in Table 5 above corresponding to tested DsiRNA agents; FIG. 1 also presents a comparison of structures used in the experiment). All DsiRNA agents showed efficacy as HIF-1α inhibitors, with 35 of 40 tested DsiRNA agents exhibiting greater than 50% reduction of the HIF-1α target. As shown in FIG. 7, for twenty-four of forty DsiRNA-cognate siRNA pairs tested, the DsiRNA agent exhibited significantly superior efficacy in decreasing levels of HIF-1α target than the cognate siRNA agent. Such inhibitory effects were examined at 24 hours post-administration, at concentrations of 0.1 nM. This result was in marked contrast to the only four of 40 instances in which the cognate siRNA agent outperformed the DsiRNA agent (FIG. 7). Thus, statistically significant distinctions were observed between DsiRNAs and matched cognate siRNAs (possessing aligned projected Ago2 cleavage sites) across the HIF-1α target RNA. By a large majority, the DsiRNAs dramatically and unexpectedly outperformed cognate siRNAs. Importantly, these results demonstrated that DsiRNA activity did not directly correlate with siRNA activity, nor did the converse hold. Accordingly, the above results demonstrated that DsiRNAs and siRNAs engage the RNA interference machinery differently, and that DsiRNAs and siRNAs—in spite of both comprising double-stranded RNA—are, in fact, different drugs.

Example 9

Figure 8A:
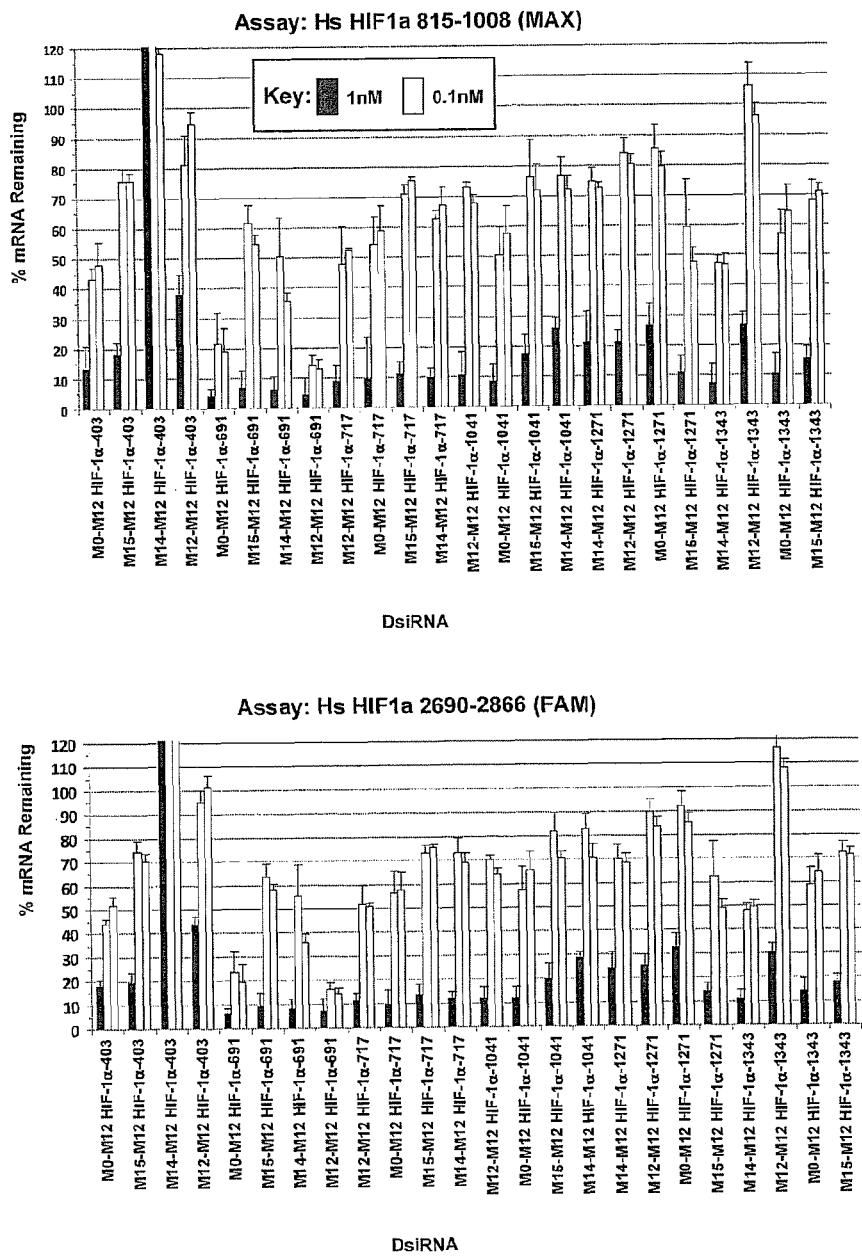
Figure 8B:
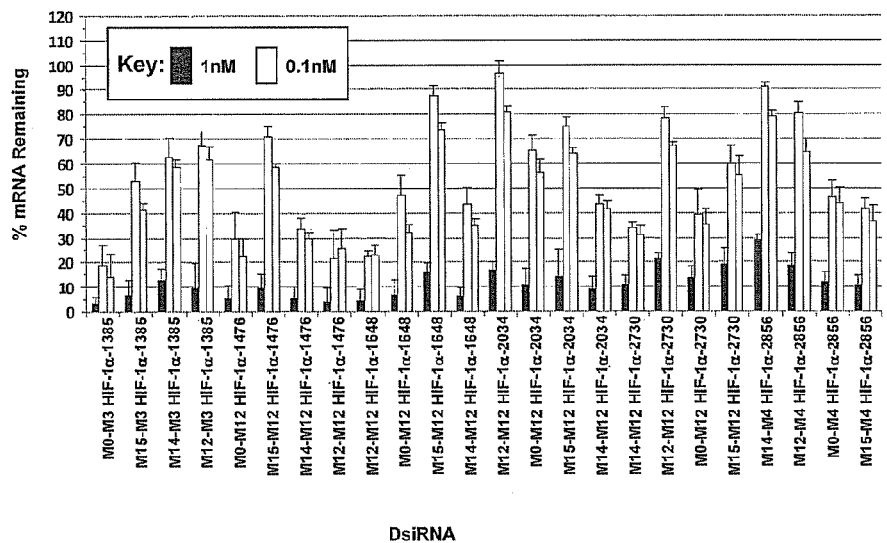
Figure 8B:
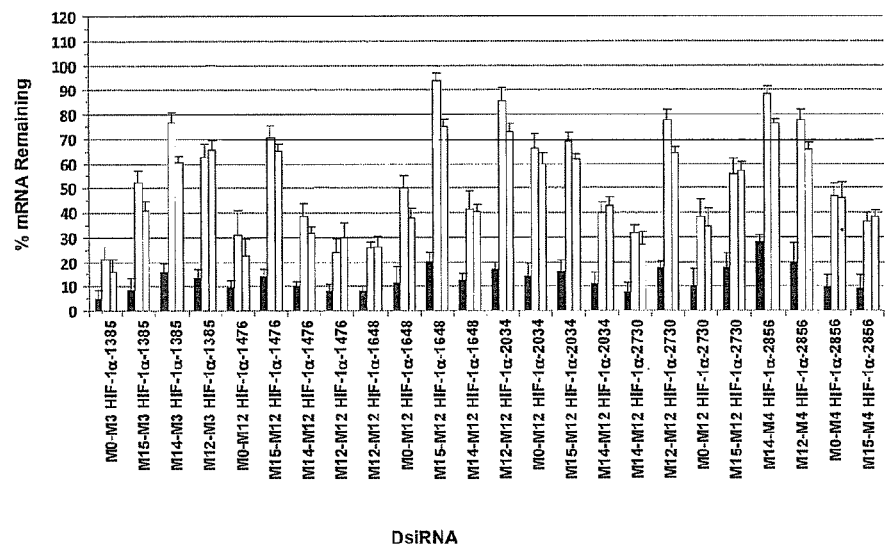
Figure 8F:
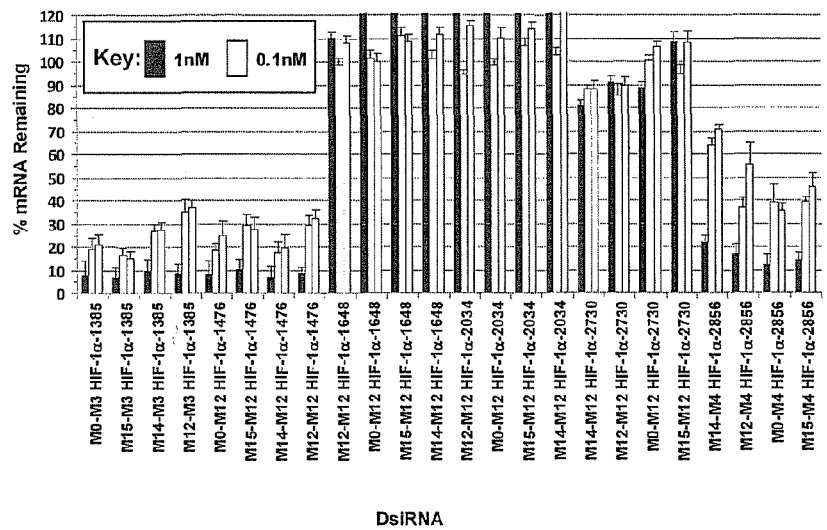
Figure 8F:
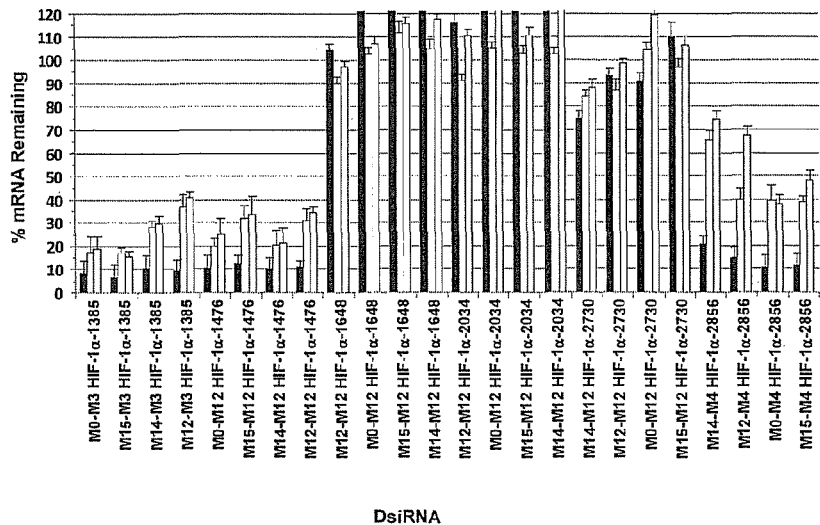
Figure 8G:
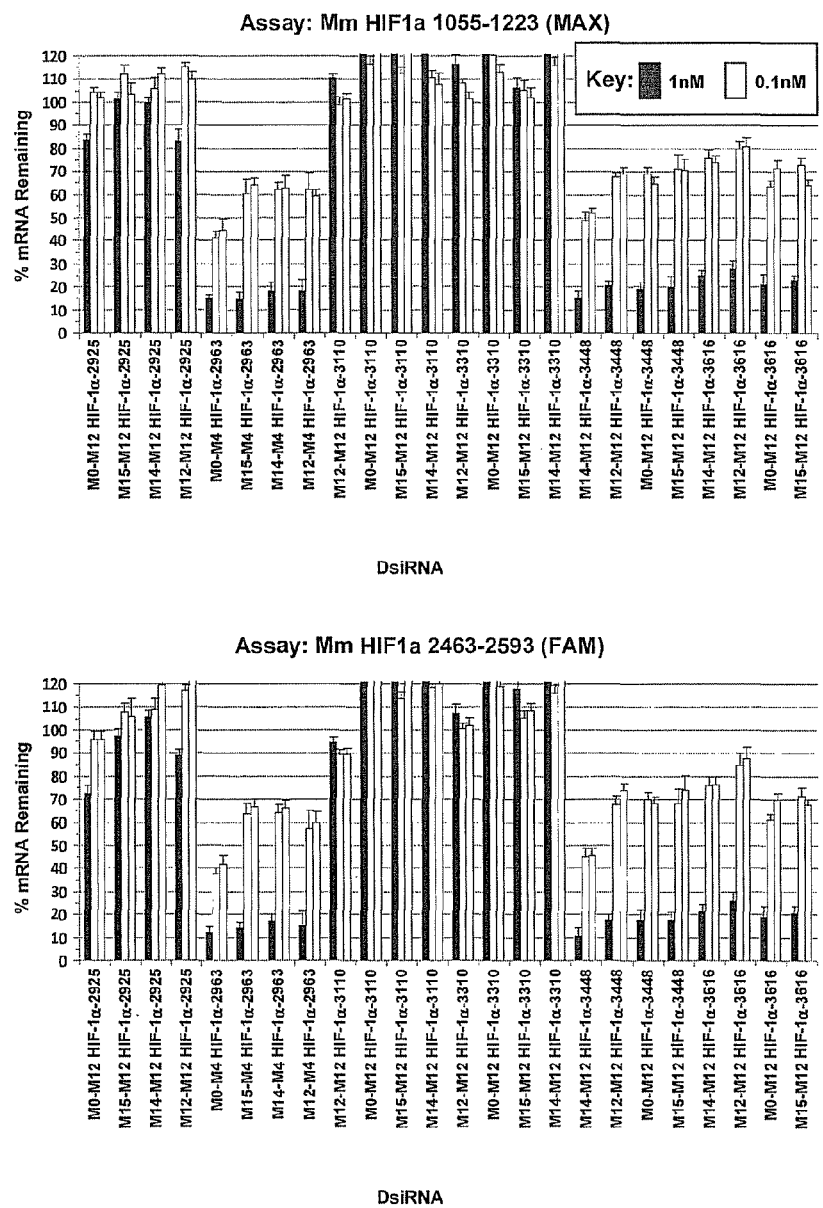
Figure 8H:
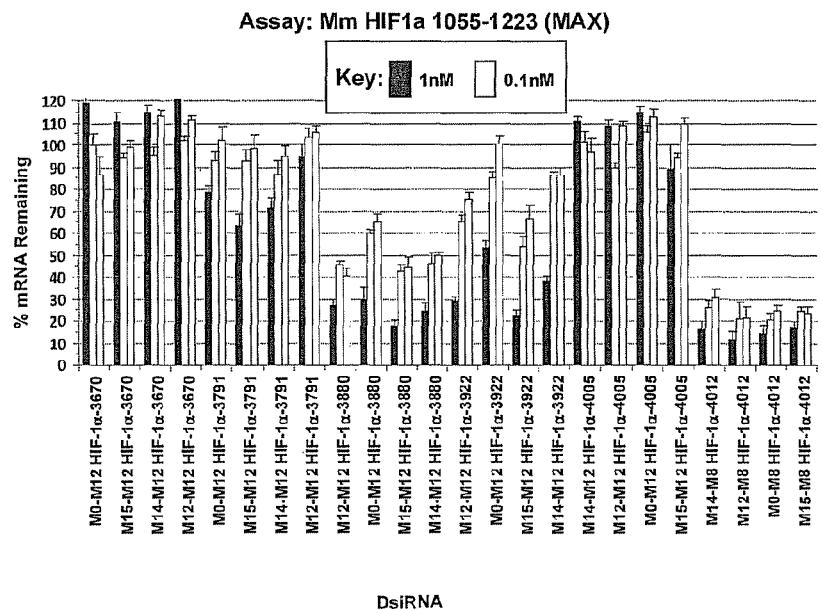
Figure 8H:
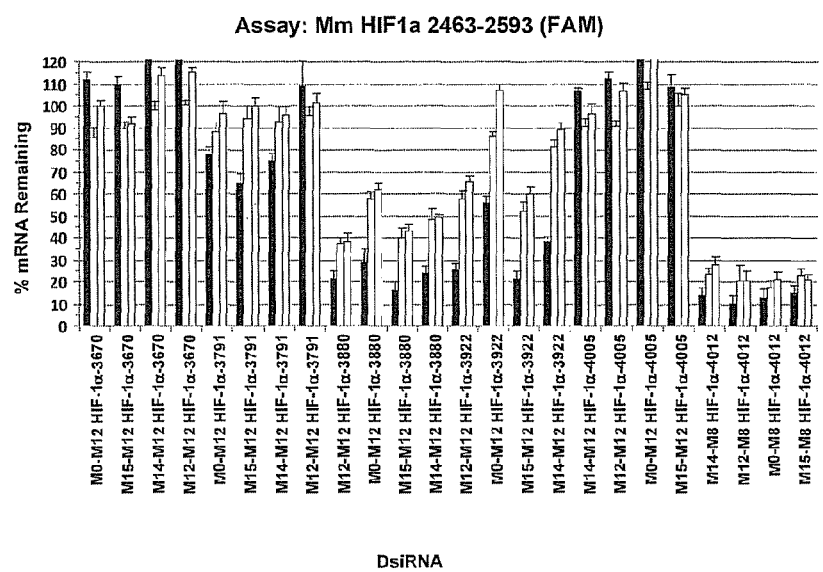

Additional Modified Forms of HIF-1α-Targeting DsiRNAs Reduced HIF-1α Levels In Vitro 24 HIF-1α-targeting DsiRNAs (HIF-1α-403, HIF-1α-691, HIF-1α-717, HIF-1α-1041, HIF-1α-1271, HIF-1α-1343, HIF-1α-1385, HIF-1α-1476, HIF-1α-1648, HIF-1α-2034, HIF-1α-2730, HIF-1α-2856, HIF-1α-2925, HIF-1α-2963, HIF-1α-3110, HIF-1α-3310, HIF-1α-3448, HIF-1α-3616, HIF-1α-3670, HIF-1α-3791, HIF-1α-3880, HIF-1α-3922, HIF-1α-4005 and HIF-1α-4012) were prepared with 2'-O-methyl modification patterns on guide and passenger strands as indicated within x-axis identifiers of FIGS. 8A to 8H (e.g., an identifier of "M14-M12 HIF-1α-691" in FIG. 8A indicates that the guide strand of the modified HIF-1α-691 duplex possesses the "M14" modification pattern while the passenger strand possesses the "M12" modification pattern). For each of the 24 DsiRNA sequences, four different combinations of guide and passenger strand modifications were tested, via assay for human HIF-1α inhibition in human HeLa cells at 0.1 nM (in parallel assays) and 1.0 nM concentrations in the environment of the HeLa cells, as well as assay for mouse HIF-1α inhibition in mouse Hepa 1-6 cells at 0.1 nM (in parallel assays) and 1.0 nM concentrations in the environment of the Hepa 1-6 cells. Results of these experiments are presented as histograms in FIGS. 8A to 8H. In general, as for modifications of only the guide strands in Example 5 above, the 24 DsiRNA sequences exhibited a trend towards reduced efficacy of HIF-1α inhibition as the extent of 2'-O-methyl modification of guide and passenger strands increased. However, for almost all DsiRNA sequences examined, a modification pattern could be identified that allowed the DsiRNA to retain significant HIF-1α inhibitory efficacy in vitro. It was also notable that many DsiRNAs (e.g., HIF-1α-691, HIF-1α-1476, HIF-1α-3670, HIF-1α-3791 and HIF-1α-4012) exhibited robust HIF-1α inhibitory efficacy in even the most highly modified states examined. These data further indicated that modification strategies of both guide and passenger strand to stabilize such DsiRNAs and/or reduce immunogenicity of such DsiRNAs when therapeutically administered to a subject in vivo could be implemented while retaining knockdown activity.

Example 10

In Vivo Efficacy of HIF-1α-Targeting DsiRNAs in Targeted Tissues

Eight DsiRNAs directed against HIF-1α and possessing guide strand 2'-O-methyl modification patterns (HIF-1α-1385-M4, HIF-1α-1478-M3, HIF-1α-2856-M4, HIF-1α-2882-M8, HIF-1α-2963-M4, HIF-1α-3865-M3, HIF-1α-3916-M3 and HIF-1α-4012-M1, with guide strand modification patterns indicated) were examined for the ability to inhibit HIF-1α mRNA levels in vivo. To perform such assessment, DsiRNAs were formulated in InVivo-Fectamine™ 2.0 (InVitrogen™), and were administered at a dose of 10 mg/kg body weight. Ten groups of CD1 female mice were injected once with one of the eight different HIF-1α-targeting DsiRNAs (n=5/group). Liver tissues were then collected at 72 hours post-injection. A Promega™ SV96 RNA isolation kit was used to extract RNA from harvested liver tissues. A Transcriptor First Strand cDNA Synthesis Kit (Roche™ #04 897 030 001) was then used for cDNA synthesis, which involved input of 3 ul of total RNA, Oligo(dT) as primer and a pre-heat of about five minutes at 70° C. before adding cDNA mix. A 1/20 dilution of cDNA was then prepared and 4 ul of this dilution was used for qPCR using iQ Multiplex Powermix kit (BioRad™ #172-5849). Mm-HIF1α-FAM and Mm-HPRT-Cy5 primers/probes were used respectively as target and housekeeping gene primers for performance of qPCR in multiplex reactions. As shown in FIG. 9, each of the HIF-1α-targeting DsiRNAs examined was shown to reduce mouse HIF-1α levels in normal mouse liver by approximately 80% or more at three days post-injection. Thus, HIF-1α-targeting DsiRNAs exhibited exceptional in vivo activities.

Example 11

Indications

The present body of knowledge in HIF-1α research indicates the need for methods to assay HIF-1α activity and for compounds that can regulate HIF-1α expression for research, diagnostic, and therapeutic use. As described herein, the nucleic acid molecules of the present invention can be used in assays to diagnose disease state related to HIF-1α levels. In addition, the nucleic acid molecules can be used to treat disease state related to HIF-1α misregulation, levels, etc.

Particular disorders and disease states that can be associated with HIF-1α expression modulation include, but are not limited to cancer and/or proliferative diseases, conditions, or disorders and other diseases, conditions or disorders that are related to or will respond to the levels of HIF-1α in a cell or tissue, alone or in combination with other therapies. Particular degenerative and disease states that are associated with HIF-1α expression modulation include but are not limited to, for example, renal cancer, breast cancer, lung cancer, ovarian cancer, cervical cancer, esophageal cancer, oropharyngeal cancer, and pancreatic cancer.

Gemcitabine and cyclophosphamide are non-limiting examples of chemotherapeutic agents that can be combined with or used in conjunction with the nucleic acid molecules (e.g. DsiRNA molecules) of the instant invention. Those skilled in the art will recognize that other drugs such as anti-cancer compounds and therapies can be similarly be readily combined with the nucleic acid molecules of the instant invention (e.g. DsiRNA molecules) and are hence within the scope of the instant invention. Such compounds and therapies are well known in the art (see for example Cancer: Principles and Practice of Oncology, Volumes 1 and 2, eds Devita, V. T., Hellman, S., and Rosenberg, S. A., J. B. Lippincott Company, Philadelphia, USA) and include, without limitations, antifolates; fluoropyrimidines; cytarabine; purine analogs; adenosine analogs; amsacrine; topoisomerase I inhibitors; anthrapyrazoles; retinoids; antibiotics such as bleomycin, anthacyclins, mitomycin C, dactinomycin, and mithramycin; hexamethylmelamine; dacarbazine; 1-asperginase; platinum analogs; alkylating agents such as nitrogen mustard, melphalan, chlorambucil, busulfan, ifosfamide, 4-hydroperoxycyclophosphamide, nitrosoureas, thiotepa; plant derived compounds such as vinca alkaloids, epipodophyllotoxins, taxol; Tamoxifen; radiation therapy; surgery; nutritional supplements; gene therapy; radiotherapy such as 3D-CRT; immunotoxin therapy such as ricin, monoclonal antibodies Herceptin; and the like. For combination therapy, the nucleic acids of the invention are prepared in one of two ways. First, the agents are physically combined in a preparation of nucleic acid and chemotherapeutic agent, such as a mixture of a nucleic acid of the invention encapsulated in liposomes and ifosfamide in a solution for intravenous administration, wherein both agents are present in a therapeutically effective concentration (e.g., ifosfamide in solution to deliver 1000-1250 mg/m2/day and liposome-associated nucleic acid of the invention in the same solution to deliver 0.1-100 mg/kg/day). Alternatively, the agents are administered separately but simultaneously in their respective effective doses (e.g., 1000-1250 mg/m2/d ifosfamide and 0.1 to 100 mg/kg/day nucleic acid of the invention).

Those skilled in the art will recognize that other compounds and therapies used to treat the diseases and conditions described herein can similarly be combined with the nucleic acid molecules of the instant invention (e.g. siNA molecules) and are hence within the scope of the instant invention.

Example 12

Serum Stability for DsiRNAs

Serum stability of DsiRNA agents is assessed via incubation of DsiRNA agents in 50% fetal bovine serum for various periods of time (up to 24 h) at 37° C. Serum is extracted and the nucleic acids are separated on a 20% non-denaturing PAGE and can be visualized with Gelstar stain. Relative levels of protection from nuclease degradation are assessed for DsiRNAs (optionally with and without modifications).

Example 13

Use of Additional Cell Culture Models to Evaluate the Down-Regulation of HIF-1α Gene Expression A variety of endpoints have been used in cell culture models to look at HIF-1α-mediated effects after treatment with anti-HIF-1α agents. Phenotypic endpoints include inhibition of cell proliferation, RNA expression, and reduction of HIF-1α protein expression. Because HIF-1α mutations are directly associated with increased proliferation of certain tumor cells, a proliferation endpoint for cell culture assays is can be used as a screen. There are several methods by which this endpoint can be measured. Following treatment of cells with DsiRNA, cells are allowed to grow (typically 5 days), after which the cell viability, the incorporation of bromodeoxyuridine (BrdU) into cellular DNA and/or the cell density are measured. The assay of cell density can be done in a 96-well format using commercially available fluorescent nucleic acid stains (such as Syto® 13 or CyQuant®). As a secondary, confirmatory endpoint, a DsiRNA-mediated decrease in the level of HIF-1α protein expression can be evaluated using a HIF-1α-specific ELISA.

Example 14

Evaluation of Anti-HIF-1α DsiRNA Efficacy in a Mouse Model of HIF-1α Misregulation Anti-HIF-1α DsiRNA chosen from in vitro assays can be further tested in mouse models, including, e.g., xenograft and other animal models as recited above. In one example, mice possessing misregulated (e.g., elevated) HIF-1α levels are administered a DsiRNA agent of the present invention via hydrodynamic tail vein injection. 3-4 mice per group (divided based upon specific DsiRNA agent tested) are injected with 50 µg or 200 µg of DsiRNA. Levels of HIF-1α RNA are evaluated using RT-qPCR. Additionally or alternatively, levels of HIF-1α (e.g., HIF-1α protein levels and/or cancer cell/tumor formation, growth or spread) can be evaluated using an art-recognized method, or phenotypes associated with misregulation of HIF-1α (e.g., tumor formation, growth, metastasis, etc.) are monitored (optionally as a proxy for measurement of HIF-1α transcript or HIF-1α protein levels). Active DsiRNA in such animal models can also be subsequently tested in combination with standard chemotherapies.

Example 15

Diagnostic Uses

The DsiRNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of DsiRNA molecules involves utilizing reconstituted RNAi systems, for example, using cellular lysates or partially purified cellular lysates. DsiRNA molecules of this invention can be used as diagnostic tools to examine genetic drift and mutations within diseased cells. The close relationship between DsiRNA activity and the structure of the target HIF-1α RNA allows the detection of mutations in a region of the HIF-1α molecule, which alters the base-pairing and three-dimensional structure of the target HIF-1α RNA. By using multiple DsiRNA molecules described in this invention, one can map nucleotide changes, which are important to RNA structure and function in vitro, as well as in cells and tissues. Cleavage of target HIF-1α RNAs with DsiRNA molecules can be used to inhibit gene expression and define the role of specified gene products in the progression of a HIF-1α-associated disease or disorder. In this manner, other genetic targets can be defined as important mediators of the disease. These experiments will lead to better treatment of the disease progression by affording the possibility of combination therapies (e.g., multiple DsiRNA molecules targeted to different genes, DsiRNA molecules coupled with known small molecule inhibitors, or intermittent treatment with combinations of DsiRNA molecules and/or other chemical or biological molecules). Other in vitro uses of DsiRNA molecules of this invention are well known in the art, and include detection of the presence of RNAs associated with a disease or related condition. Such RNA is detected by determining the presence of a cleavage product after treatment with a DsiRNA using standard methodologies, for example, fluorescence resonance emission transfer (FRET).

In a specific example, DsiRNA molecules that cleave only wild-type or mutant or polymorphic forms of the target HIF-1α RNA are used for the assay. The first DsiRNA molecules (i.e., those that cleave only wild-type forms of target HIF-1α RNA) are used to identify wild-type HIF-1α RNA present in the sample and the second DsiRNA molecules (i.e., those that cleave only mutant or polymorphic forms of target RNA) are used to identify mutant or polymorphic HIF-1α RNA in the sample. As reaction controls, synthetic substrates of both wild-type and mutant or polymorphic HIF-1α RNA are cleaved by both DsiRNA molecules to demonstrate the relative DsiRNA efficiencies in the reactions and the absence of cleavage of the "non-targeted" HIF-1α RNA species. The cleavage products from the synthetic substrates also serve to generate size markers for the analysis of wild-type and mutant HIF-1α RNAs in the sample population. Thus, each analysis requires two DsiRNA molecules, two substrates and one unknown sample, which is combined into six reactions. The presence of cleavage products is determined using an RNase protection assay so that full-length and cleavage fragments of each HIF-1α RNA can be analyzed in one lane of a polyacrylamide gel. It is not absolutely required to quantify the results to gain insight into the expression of mutant or polymorphic HIF-1α RNAs and putative risk of HIF-1α-associated phenotypic changes in target cells. The expression of HIF-1α mRNA whose protein product is implicated in the development of the phenotype (i.e., disease related/associated) is adequate to establish risk. If probes of comparable specific activity are used for both transcripts, then a qualitative comparison of HIF-1α RNA levels is adequate and decreases the cost of the initial diagnosis. Higher mutant or polymorphic form to wild-type ratios are correlated with higher risk whether HIF-1α RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying DsiRNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein, including the best mode known to the inventors for carrying out the invention. Variations of those embodiments may become apparent to those of ordinary skill in the art upon reading the foregoing description.

The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. Those skilled in the art will recognize, or be able to ascertain using no more than routine experimentation, many equivalents to the specific embodiments of the invention described herein. Such equivalents are intended to be encompassed by the following claims.

SEQUENCE LISTING (5165 sequences)

SEQ ID NO: 1 - RNA, 27 nt, Artificial Sequence
  Description of Artificial Sequence: Synthetic oligonucleotide
  Description of Combined DNA/RNA Molecule: Synthetic oligonucleotide
agggcggaggcgcgcucgggcgcgcgg

SEQ ID NO: 2 - RNA, 27 nt, Artificial Sequence
  Description of Artificial Sequence: Synthetic oligonucleotide
  Description of Combined DNA/RNA Molecule: Synthetic oligonucleotide
caagggcggaggcgcgcucgggcgcgc

SEQ ID NO: 3 - RNA, 27 nt, Artificial Sequence
  Description of Artificial Sequence: Synthetic oligonucleotide
  Description of Combined DNA/RNA Molecule: Synthetic oligonucleotide
ggcaagggcggaggcgcgcucgggcgc

SEQ ID NO: 4 - RNA, 27 nt, Artificial Sequence
  Description of Artificial Sequence: Synthetic oligonucleotide
  Description of Combined DNA/RNA Molecule: Synthetic oligonucleotide
cgggcaagggcggaggcgcgcucgggc

SEQ ID NO: 5 - RNA, 27 nt, Artificial Sequence
  Description of Artificial Sequence: Synthetic oligonucleotide
  Description of Combined DNA/RNA Molecule: Synthetic oligonucleotide
ggcgggcaagggcggaggcgcgcucgg

SEQ ID NO: 6 - RNA, 27 nt, Artificial Sequence
  Description of Artificial Sequence: Synthetic oligonucleotide
  Description of Combined DNA/RNA Molecule: Synthetic oligonucleotide
cacugugcacugaggagcugaggcagc

SEQ ID NO: 7 - RNA, 27 nt, Artificial Sequence
  Description of Artificial Sequence: Synthetic oligonucleotide
  Description of Combined DNA/RNA Molecule: Synthetic oligonucleotide
gcacugugcacugaggagcugaggcag

SEQ ID NO: 8 - RNA, 27 nt, Artificial Sequence
  Description of Artificial Sequence: Synthetic oligonucleotide
  Description of Combined DNA/RNA Molecule: Synthetic oligonucleotide
cagcacugugcacugaggagcugaggc

SEQ ID NO: 9 - RNA, 27 nt, Artificial Sequence
  Description of Artificial Sequence: Synthetic oligonucleotide
  Description of Combined DNA/RNA Molecule: Synthetic oligonucleotide
gaggcagcacugugcacugaggagcug

SEQ ID NO: 10 - RNA, 27 nt, Artificial Sequence
  Description of Artificial Sequence: Synthetic oligonucleotide
  Description of Combined DNA/RNA Molecule: Synthetic oligonucleotide
cgaggcagcacugugcacugaggagcu

SEQ ID NO: 11 - RNA, 27 nt, Artificial Sequence
  Description of Artificial Sequence: Synthetic oligonucleotide
  Description of Combined DNA/RNA Molecule: Synthetic oligonucleotide
cuccuguccccucagacgaggcagcac

SEQ ID NO: 12 - RNA, 27 nt, Artificial Sequence
  Description of Artificial Sequence: Synthetic oligonucleotide
  Description of Combined DNA/RNA Molecule: Synthetic oligonucleotide
gagacuagagagaagcgggcggcaauc

SEQ ID NO: 13 - RNA, 27 nt, Artificial Sequence
  Description of Artificial Sequence: Synthetic oligonucleotide
  Description of Combined DNA/RNA Molecule: Synthetic oligonucleotide
gugagacuagagagaagcgggcggcaa

SEQ ID NO: 14 - RNA, 27 nt, Artificial Sequence
  Description of Artificial Sequence: Synthetic oligonucleotide
  Description of Combined DNA/RNA Molecule: Synthetic oligonucleotide
cgugagacuagagagaagcgggcggca

SEQ ID NO: 15 - RNA, 27 nt, Artificial Sequence
  Description of Artificial Sequence: Synthetic oligonucleotide
  Description of Combined DNA/RNA Molecule: Synthetic oligonucleotide
gggggugcgaggcgggaaaccccucgu

SEQ ID NO: 16 - RNA, 27 nt, Artificial Sequence
  Description of Artificial Sequence: Synthetic oligonucleotide
  Description of Combined DNA/RNA Molecule: Synthetic oligonucleotide
aagagaaggaaaggcaaguccagaggu

SEQ ID NO: 17 - RNA, 27 nt, Artificial Sequence
  Description of Artificial Sequence: Synthetic oligonucleotide
  Description of Combined DNA/RNA Molecule: Synthetic oligonucleotide
gagaagagaaggaaaggcaaguccaga

SEQ ID NO: 18 - RNA, 27 nt, Artificial Sequence
  Description of Artificial Sequence: Synthetic oligonucleotide
  Description of Combined DNA/RNA Molecule: Synthetic oligonucleotide
cggagaagagaaggaaaggcaagucca

SEQ ID NO: 19 - RNA, 27 nt, Artificial Sequence
  Description of Artificial Sequence: Synthetic oligonucleotide
  Description of Combined DNA/RNA Molecule: Synthetic oligonucleotide
acgcggagaagagaaggaaaggcaagu

SEQ ID NO: 20 - RNA, 27 nt, Artificial Sequence
  Description of Artificial Sequence: Synthetic oligonucleotide
  Description of Combined DNA/RNA Molecule: Synthetic oligonucleotide
acacgcggagaagagaaggaaaggcaa

SEQ ID NO: 21 - RNA, 27 nt, Artificial Sequence
  Description of Artificial Sequence: Synthetic oligonucleotide
  Description of Combined DNA/RNA Molecule: Synthetic oligonucleotide
cacacgcggagaagagaaggaaaggca

SEQ ID NO: 22 - RNA, 27 nt, Artificial Sequence
  Description of Artificial Sequence: Synthetic oligonucleotide
  Description of Combined DNA/RNA Molecule: Synthetic oligonucleotide
ccacacgcggagaagagaaggaaaggc

SEQ ID NO: 23 - RNA, 27 nt, Artificial Sequence
  Description of Artificial Sequence: Synthetic oligonucleotide
  Description of Combined DNA/RNA Molecule: Synthetic oligonucleotide
gcuggcucccuccacacgcggagaaga

SEQ ID NO: 24 - RNA, 27 nt, Artificial Sequence
  Description of Artificial Sequence: Synthetic oligonucleotide
  Description of Combined DNA/RNA Molecule: Synthetic oligonucleotide
gcgcuggcucccuccacacgcggagaa

SEQ ID NO: 25 - RNA, 27 nt, Artificial Sequence
  Description of Artificial Sequence: Synthetic oligonucleotide
  Description of Combined DNA/RNA Molecule: Synthetic oligonucleotide
aagcgcuggcucccuccacacgcggag

SEQ ID NO: 26 - RNA, 27 nt, Artificial Sequence
  Description of Artificial Sequence: Synthetic oligonucleotide
  Description of Combined DNA/RNA Molecule: Synthetic oligonucleotide
cucgcuccggccuaagcgcuggcuccc

SEQ ID NO: 27 - RNA, 27 nt, Artificial Sequence
  Description of Artificial Sequence: Synthetic oligonucleotide
  Description of Combined DNA/RNA Molecule: Synthetic oligonucleotide
gugaaucgguccccgcgaugucuucac

SEQ ID NO: 28 - RNA, 27 nt, Artificial Sequence
  Description of Artificial Sequence: Synthetic oligonucleotide
  Description of Combined DNA/RNA Molecule: Synthetic oligonucleotide
gccgccggcgcccuccauggugaaucg

SEQ ID NO: 29 - RNA, 27 nt, Artificial Sequence
  Description of Artificial Sequence: Synthetic oligonucleotide
  Description of Combined DNA/RNA Molecule: Synthetic oligonucleotide
uucgcgccgccggcgcccuccauggug

SEQ ID NO: 30 - RNA, 27 nt, Artificial Sequence
  Description of Artificial Sequence: Synthetic oligonucleotide
  Description of Combined DNA/RNA Molecule: Synthetic oligonucleotide
cguucgcgccgccggcgcccuccaugg

SEQ ID NO: 31 - RNA, 27 nt, Artificial Sequence
  Description of Artificial Sequence: Synthetic oligonucleotide
  Description of Combined DNA/RNA Molecule: Synthetic oligonucleotide
gaacuuaucuuuuucuugucguucgcg

SEQ ID NO: 32 - RNA, 27 nt, Artificial Sequence
  Description of Artificial Sequence: Synthetic oligonucleotide
  Description of Combined DNA/RNA Molecule: Synthetic oligonucleotide
acguucagaacuuaucuuuuucuuguc

SEQ ID NO: 33 - RNA, 27 nt, Artificial Sequence
  Description of Artificial Sequence: Synthetic oligonucleotide
  Description of Combined DNA/RNA Molecule: Synthetic oligonucleotide
gacuuuucuuuucgacguucagaacuu

SEQ ID NO: 34 - RNA, 27 nt, Artificial Sequence
  Description of Artificial Sequence: Synthetic oligonucleotide
  Description of Combined DNA/RNA Molecule: Synthetic oligonucleotide
gagacuuuucuuuucgacguucagaac

SEQ ID NO: 35 - RNA, 27 nt, Artificial Sequence
  Description of Artificial Sequence: Synthetic oligonucleotide
  Description of Combined DNA/RNA Molecule: Synthetic oligonucleotide
ucgagacuuuucuuuucgacguucaga

SEQ ID NO: 36 - RNA, 27 nt, Artificial Sequence
  Description of Artificial Sequence: Synthetic oligonucleotide
  Description of Combined DNA/RNA Molecule: Synthetic oligonucleotide
ucucgagacuuuucuuuucgacguuca

SEQ ID NO: 37 - RNA, 27 nt, Artificial Sequence
  Description of Artificial Sequence: Synthetic oligonucleotide
  Description of Combined DNA/RNA Molecule: Synthetic oligonucleotide
caagcucauaaaaaacuucagauucuu

SEQ ID NO: 38 - RNA, 27 nt, Artificial Sequence
  Description of Artificial Sequence: Synthetic oligonucleotide
  Description of Combined DNA/RNA Molecule: Synthetic oligonucleotide
gagcaagcucauaaaaaacuucagauu

SEQ ID NO: 39 - RNA, 27 nt, Artificial Sequence
  Description of Artificial Sequence: Synthetic oligonucleotide
  Description of Combined DNA/RNA Molecule: Synthetic oligonucleotide
augagcaagcucauaaaaaacuucaga

SEQ ID NO: 40 - RNA, 27 nt, Artificial Sequence
  Description of Artificial Sequence: Synthetic oligonucleotide
  Description of Combined DNA/RNA Molecule: Synthetic oligonucleotide
ugaugagcaagcucauaaaaaacuuca

SEQ ID NO: 41 - RNA, 27 nt, Artificial Sequence
  Description of Artificial Sequence: Synthetic oligonucleotide
  Description of Combined DNA/RNA Molecule: Synthetic oligonucleotide
acugaugagcaagcucauaaaaaacuu

SEQ ID NO: 42 - RNA, 27 nt, Artificial Sequence
  Description of Artificial Sequence: Synthetic oligonucleotide
  Description of Combined DNA/RNA Molecule: Synthetic oligonucleotide
caacugaugagcaagcucauaaaaaac

SEQ ID NO: 43 - RNA, 27 nt, Artificial Sequence
  Description of Artificial Sequence: Synthetic oligonucleotide
  Description of Combined DNA/RNA Molecule: Synthetic oligonucleotide
ggcaacugaugagcaagcucauaaaaa

SEQ ID NO: 44 - RNA, 27 nt, Artificial Sequence
  Description of Artificial Sequence: Synthetic oligonucleotide
  Description of Combined DNA/RNA Molecule: Synthetic oligonucleotide
guggcaacugaugagcaagcucauaaa

SEQ ID NO: 45 - RNA, 27 nt, Artificial Sequence
  Description of Artificial Sequence: Synthetic oligonucleotide
  Description of Combined DNA/RNA Molecule: Synthetic oligonucleotide
aaguggcaacugaugagcaagcucaua

SEQ ID NO: 46 - RNA, 27 nt, Artificial Sequence
  Description of Artificial Sequence: Synthetic oligonucleotide
  Description of Combined DNA/RNA Molecule: Synthetic oligonucleotide
ggaaguggcaacugaugagcaagcuca

SEQ ID NO: 47 - RNA, 27 nt, Artificial Sequence
  Description of Artificial Sequence: Synthetic oligonucleotide
  Description of Combined DNA/RNA Molecule: Synthetic oligonucleotide
guggaaguggcaacugaugagcaagcu

SEQ ID NO: 48 - RNA, 27 nt, Artificial Sequence
  Description of Artificial Sequence: Synthetic oligonucleotide
  Description of Combined DNA/RNA Molecule: Synthetic oligonucleotide
auguggaaguggcaacugaugagcaag

SEQ ID NO: 49 - RNA, 27 nt, Artificial Sequence
  Description of Artificial Sequence: Synthetic oligonucleotide
  Description of Combined DNA/RNA Molecule: Synthetic oligonucleotide
uuauguggaaguggcaacugaugagca

SEQ ID NO: 50 - RNA, 27 nt, Artificial Sequence
  Description of Artificial Sequence: Synthetic oligonucleotide
  Description of Combined DNA/RNA Molecule: Synthetic oligonucleotide
ugcgaacucacauuauguggaaguggc

SEQ ID NO: 51 - RNA, 27 nt, Artificial Sequence
  Description of Artificial Sequence: Synthetic oligonucleotide
  Description of Combined DNA/RNA Molecule: Synthetic oligonucleotide
uauccaaaucaccagcauccagaaguu

SEQ ID NO: 52 - RNA, 27 nt, Artificial Sequence
  Description of Artificial Sequence: Synthetic oligonucleotide
  Description of Combined DNA/RNA Molecule: Synthetic oligonucleotide
aauauccaaaucaccagcauccagaag

SEQ ID NO: 53 - RNA, 27 nt, Artificial Sequence
  Description of Artificial Sequence: Synthetic oligonucleotide
  Description of Combined DNA/RNA Molecule: Synthetic oligonucleotide
caauauccaaaucaccagcauccagaa

SEQ ID NO: 54 - RNA, 27 nt, Artificial Sequence
  Description of Artificial Sequence: Synthetic oligonucleotide
  Description of Combined DNA/RNA Molecule: Synthetic oligonucleotide
cugugcuuucaugucaucuucaauauc

SEQ ID NO: 55 - RNA, 27 nt, Artificial Sequence
  Description of Artificial Sequence: Synthetic oligonucleotide
  Description of Combined DNA/RNA Molecule: Synthetic oligonucleotide
aaggcuuucaaauaaaagcaauucauc

SEQ ID NO: 56 - RNA, 27 nt, Artificial Sequence
  Description of Artificial Sequence: Synthetic oligonucleotide
  Description of Combined DNA/RNA Molecule: Synthetic oligonucleotide
cauaacaaaaccauccaaggcuuucaa

SEQ ID NO: 57 - RNA, 27 nt, Artificial Sequence
  Description of Artificial Sequence: Synthetic oligonucleotide
  Description of Combined DNA/RNA Molecule: Synthetic oligonucleotide
gaaccauaacaaaaccauccaaggcuu

SEQ ID NO: 58 - RNA, 27 nt, Artificial Sequence
  Description of Artificial Sequence: Synthetic oligonucleotide
  Description of Combined DNA/RNA Molecule: Synthetic oligonucleotide
gagaaccauaacaaaaccauccaaggc

SEQ ID NO: 59 - RNA, 27 nt, Artificial Sequence
  Description of Artificial Sequence: Synthetic oligonucleotide
  Description of Combined DNA/RNA Molecule: Synthetic oligonucleotide
gugagaaccauaacaaaaccauccaag

SEQ ID NO: 60 - RNA, 27 nt, Artificial Sequence
  Description of Artificial Sequence: Synthetic oligonucleotide
  Description of Combined DNA/RNA Molecule: Synthetic oligonucleotide
cugugagaaccauaacaaaaccaucca

SEQ ID NO: 61 - RNA, 27 nt, Artificial Sequence
  Description of Artificial Sequence: Synthetic oligonucleotide
  Description of Combined DNA/RNA Molecule: Synthetic oligonucleotide
uguucacauuaucagaaauguaaauca

SEQ ID NO: 62 - RNA, 27 nt, Artificial Sequence
  Description of Artificial Sequence: Synthetic oligonucleotide
  Description of Combined DNA/RNA Molecule: Synthetic oligonucleotide
ccaguuaguucaaacugaguuaauccc

SEQ ID NO: 63 - RNA, 27 nt, Artificial Sequence
  Description of Artificial Sequence: Synthetic oligonucleotide
  Description of Combined DNA/RNA Molecule: Synthetic oligonucleotide
uguccaguuaguucaaacugaguuaau

SEQ ID NO: 64 - RNA, 27 nt, Artificial Sequence
  Description of Artificial Sequence: Synthetic oligonucleotide
  Description of Combined DNA/RNA Molecule: Synthetic oligonucleotide
gucacauggaugaguaaaaucaaacac

SEQ ID NO: 65 - RNA, 27 nt, Artificial Sequence
  Description of Artificial Sequence: Synthetic oligonucleotide
  Description of Combined DNA/RNA Molecule: Synthetic oligonucleotide
uggucacauggaugaguaaaaucaaac

SEQ ID NO: 66 - RNA, 27 nt, Artificial Sequence
  Description of Artificial Sequence: Synthetic oligonucleotide
  Description of Combined DNA/RNA Molecule: Synthetic oligonucleotide
cauggucacauggaugaguaaaaucaa

SEQ ID NO: 67 - RNA, 27 nt, Artificial Sequence
  Description of Artificial Sequence: Synthetic oligonucleotide
  Description of Combined DNA/RNA Molecule: Synthetic oligonucleotide
cucauggucacauggaugaguaaaauc

SEQ ID NO: 68 - RNA, 27 nt, Artificial Sequence
  Description of Artificial Sequence: Synthetic oligonucleotide
  Description of Combined DNA/RNA Molecule: Synthetic oligonucleotide
uccucauggucacauggaugaguaaaa

SEQ ID NO: 69 - RNA, 27 nt, Artificial Sequence
  Description of Artificial Sequence: Synthetic oligonucleotide
  Description of Combined DNA/RNA Molecule: Synthetic oligonucleotide
uuuccucauggucacauggaugaguaa

SEQ ID NO: 70 - RNA, 27 nt, Artificial Sequence
  Description of Artificial Sequence: Synthetic oligonucleotide
  Description of Combined DNA/RNA Molecule: Synthetic oligonucleotide
cauuuccucauggucacauggaugagu

SEQ ID NO: 71 - RNA, 27 nt, Artificial Sequence
  Description of Artificial Sequence: Synthetic oligonucleotide
  Description of Combined DNA/RNA Molecule: Synthetic oligonucleotide
cucauuuccucauggucacauggauga

SEQ ID NO: 72 - RNA, 27 nt, Artificial Sequence
  Description of Artificial Sequence: Synthetic oligonucleotide
  Description of Combined DNA/RNA Molecule: Synthetic oligonucleotide
cucucauuuccucauggucacauggau

SEQ ID NO: 73 - RNA, 27 nt, Artificial Sequence
  Description of Artificial Sequence: Synthetic oligonucleotide
  Description of Combined DNA/RNA Molecule: Synthetic oligonucleotide
uucucucauuuccucauggucacaugg

SEQ ID NO: 74 - RNA, 27 nt, Artificial Sequence
  Description of Artificial Sequence: Synthetic oligonucleotide
  Description of Combined DNA/RNA Molecule: Synthetic oligonucleotide
auuucucucauuuccucauggucacau

SEQ ID NO: 75 - RNA, 27 nt, Artificial Sequence
  Description of Artificial Sequence: Synthetic oligonucleotide
  Description of Combined DNA/RNA Molecule: Synthetic oligonucleotide
gcauuucucucauuuccucauggucac

SEQ ID NO: 76 - RNA, 27 nt, Artificial Sequence
  Description of Artificial Sequence: Synthetic oligonucleotide
  Description of Combined DNA/RNA Molecule: Synthetic oligonucleotide
aagcauuucucucauuuccucaugguc

SEQ ID NO: 77 - RNA, 27 nt, Artificial Sequence
  Description of Artificial Sequence: Synthetic oligonucleotide
  Description of Combined DNA/RNA Molecule: Synthetic oligonucleotide
guaagcauuucucucauuuccucaugg

SEQ ID NO: 78 - RNA, 27 nt, Artificial Sequence
  Description of Artificial Sequence: Synthetic oligonucleotide
  Description of Combined DNA/RNA Molecule: Synthetic oligonucleotide
guguaagcauuucucucauuuccucau

SEQ ID NO: 79 - RNA, 27 nt, Artificial Sequence
  Description of Artificial Sequence: Synthetic oligonucleotide
  Description of Combined DNA/RNA Molecule: Synthetic oligonucleotide
acuucauucugagaaaaaagcuucgcu

SEQ ID NO: 80 - RNA, 27 nt, Artificial Sequence
  Description of Artificial Sequence: Synthetic oligonucleotide
  Description of Combined DNA/RNA Molecule: Synthetic oligonucleotide
guacacuucauucugagaaaaaagcuu

SEQ ID NO: 81 - RNA, 27 nt, Artificial Sequence
  Description of Artificial Sequence: Synthetic oligonucleotide
  Description of Combined DNA/RNA Molecule: Synthetic oligonucleotide
ggguacacuucauucugagaaaaaagc

SEQ ID NO: 82 - RNA, 27 nt, Artificial Sequence
  Description of Artificial Sequence: Synthetic oligonucleotide
  Description of Combined DNA/RNA Molecule: Synthetic oligonucleotide
gagguugguuacuguugguaucauaua

SEQ ID NO: 83 - RNA, 27 nt, Artificial Sequence
  Description of Artificial Sequence: Synthetic oligonucleotide
  Description of Combined DNA/RNA Molecule: Synthetic oligonucleotide
cugagguugguuacuguugguaucaua

SEQ ID NO: 84 - RNA, 27 nt, Artificial Sequence
  Description of Artificial Sequence: Synthetic oligonucleotide
  Description of Combined DNA/RNA Molecule: Synthetic oligonucleotide
cacugagguugguuacuguugguauca

SEQ ID NO: 85 - RNA, 27 nt, Artificial Sequence
  Description of Artificial Sequence: Synthetic oligonucleotide
  Description of Combined DNA/RNA Molecule: Synthetic oligonucleotide
cacacugagguugguuacuguugguau

SEQ ID NO: 86 - RNA, 27 nt, Artificial Sequence
  Description of Artificial Sequence: Synthetic oligonucleotide
  Description of Combined DNA/RNA Molecule: Synthetic oligonucleotide
cccacacugagguugguuacuguuggu

SEQ ID NO: 87 - RNA, 27 nt, Artificial Sequence
  Description of Artificial Sequence: Synthetic oligonucleotide
  Description of Combined DNA/RNA Molecule: Synthetic oligonucleotide
uacccacacugagguugguuacuguug

SEQ ID NO: 88 - RNA, 27 nt, Artificial Sequence
  Description of Artificial Sequence: Synthetic oligonucleotide
  Description of Combined DNA/RNA Molecule: Synthetic oligonucleotide
uauacccacacugagguugguuacugu

SEQ ID NO: 89 - RNA, 27 nt, Artificial Sequence
  Description of Artificial Sequence: Synthetic oligonucleotide
  Description of Combined DNA/RNA Molecule: Synthetic oligonucleotide
cuuauacccacacugagguugguuacu

SEQ ID NO: 90 - RNA, 27 nt, Artificial Sequence
  Description of Artificial Sequence: Synthetic oligonucleotide
  Description of Combined DNA/RNA Molecule: Synthetic oligonucleotide
uucuuauacccacacugagguugguua

SEQ ID NO: 91 - RNA, 27 nt, Artificial Sequence
  Description of Artificial Sequence: Synthetic oligonucleotide
  Description of Combined DNA/RNA Molecule: Synthetic oligonucleotide
aaaucagcaccaagcaggucauaggug

SEQ ID NO: 92 - RNA, 27 nt, Artificial Sequence
  Description of Artificial Sequence: Synthetic oligonucleotide
  Description of Combined DNA/RNA Molecule: Synthetic oligonucleotide
caaaucagcaccaagcaggucauaggu

SEQ ID NO: 93 - RNA, 27 nt, Artificial Sequence
  Description of Artificial Sequence: Synthetic oligonucleotide
  Description of Combined DNA/RNA Molecule: Synthetic oligonucleotide
cacaaaucagcaccaagcaggucauag

SEQ ID NO: 94 - RNA, 27 nt, Artificial Sequence
  Description of Artificial Sequence: Synthetic oligonucleotide
  Description of Combined DNA/RNA Molecule: Synthetic oligonucleotide
auggguucacaaaucagcaccaagcag

SEQ ID NO: 95 - RNA, 27 nt, Artificial Sequence
  Description of Artificial Sequence: Synthetic oligonucleotide
  Description of Combined DNA/RNA Molecule: Synthetic oligonucleotide
gaauggguucacaaaucagcaccaagc

SEQ ID NO: 96 - RNA, 27 nt, Artificial Sequence
  Description of Artificial Sequence: Synthetic oligonucleotide
  Description of Combined DNA/RNA Molecule: Synthetic oligonucleotide
aggaauggguucacaaaucagcaccaa

SEQ ID NO: 97 - RNA, 27 nt, Artificial Sequence
  Description of Artificial Sequence: Synthetic oligonucleotide
  Description of Combined DNA/RNA Molecule: Synthetic oligonucleotide
ugaggaauggguucacaaaucagcacc

SEQ ID NO: 98 - RNA, 27 nt, Artificial Sequence
  Description of Artificial Sequence: Synthetic oligonucleotide
  Description of Combined DNA/RNA Molecule: Synthetic oligonucleotide
ggugaggaauggguucacaaaucagca

SEQ ID NO: 99 - RNA, 27 nt, Artificial Sequence
  Description of Artificial Sequence: Synthetic oligonucleotide
  Description of Combined DNA/RNA Molecule: Synthetic oligonucleotide
ugggugaggaauggguucacaaaucag

SEQ ID NO: 100 - RNA, 27 nt, Artificial Sequence
  Description of Artificial Sequence: Synthetic oligonucleotide
  Description of Combined DNA/RNA Molecule: Synthetic oligonucleotide
gaugggugaggaauggguucacaaauc

SEQ ID NO: 101 - RNA, 27 nt, Artificial Sequence
  Description of Artificial Sequence: Synthetic oligonucleotide
  Description of Combined DNA/RNA Molecule: Synthetic oligonucleotide
cuaucuaaaggaauuucaauauuugau

SEQ ID NO: 102 - RNA, 27 nt, Artificial Sequence
  Description of Artificial Sequence: Synthetic oligonucleotide
  Description of Combined DNA/RNA Molecule: Synthetic oligonucleotide
ugcuaucuaaaggaauuucaauauuug

SEQ ID NO: 103 - RNA, 27 nt, Artificial Sequence
  Description of Artificial Sequence: Synthetic oligonucleotide
  Description of Combined DNA/RNA Molecule: Synthetic oligonucleotide
cuugcuaucuaaaggaauuucaauauu

SEQ ID NO: 104 - RNA, 27 nt, Artificial Sequence
  Description of Artificial Sequence: Synthetic oligonucleotide
  Description of Combined DNA/RNA Molecule: Synthetic oligonucleotide
gucuugcuaucuaaaggaauuucaaua

SEQ ID NO: 105 - RNA, 27 nt, Artificial Sequence
  Description of Artificial Sequence: Synthetic oligonucleotide
  Description of Combined DNA/RNA Molecule: Synthetic oligonucleotide
aagucuugcuaucuaaaggaauuucaa

SEQ ID NO: 106 - RNA, 27 nt, Artificial Sequence
  Description of Artificial Sequence: Synthetic oligonucleotide
  Description of Combined DNA/RNA Molecule: Synthetic oligonucleotide
gaaagucuugcuaucuaaaggaauuuc

SEQ ID NO: 107 - RNA, 27 nt, Artificial Sequence
  Description of Artificial Sequence: Synthetic oligonucleotide
  Description of Combined DNA/RNA Molecule: Synthetic oligonucleotide
aggaaagucuugcuaucuaaaggaauu

SEQ ID NO: 108 - RNA, 27 nt, Artificial Sequence
  Description of Artificial Sequence: Synthetic oligonucleotide
  Description of Combined DNA/RNA Molecule: Synthetic oligonucleotide
auaagaaaauuucauauccaggcugug

SEQ ID NO: 109 - RNA, 27 nt, Artificial Sequence
  Description of Artificial Sequence: Synthetic oligonucleotide
  Description of Combined DNA/RNA Molecule: Synthetic oligonucleotide
ucaucacaauaagaaaauuucauaucc

SEQ ID NO: 110 - RNA, 27 nt, Artificial Sequence
  Description of Artificial Sequence: Synthetic oligonucleotide
  Description of Combined DNA/RNA Molecule: Synthetic oligonucleotide
ugauaauauucauaaauugagcggccu

SEQ ID NO: 111 - RNA, 27 nt, Artificial Sequence
  Description of Artificial Sequence: Synthetic oligonucleotide
  Description of Combined DNA/RNA Molecule: Synthetic oligonucleotide
caugauaauauucauaaauugagcggc

SEQ ID NO: 112 - RNA, 27 nt, Artificial Sequence
  Description of Artificial Sequence: Synthetic oligonucleotide
  Description of Combined DNA/RNA Molecule: Synthetic oligonucleotide
agcaugauaauauucauaaauugagcg

SEQ ID NO: 113 - RNA, 27 nt, Artificial Sequence
  Description of Artificial Sequence: Synthetic oligonucleotide
  Description of Combined DNA/RNA Molecule: Synthetic oligonucleotide
aaagcaugauaauauucauaaauugag

SEQ ID NO: 114 - RNA, 27 nt, Artificial Sequence
  Description of Artificial Sequence: Synthetic oligonucleotide
  Description of Combined DNA/RNA Molecule: Synthetic oligonucleotide
ccaaagcaugauaauauucauaaauug

SEQ ID NO: 115 - RNA, 27 nt, Artificial Sequence
  Description of Artificial Sequence: Synthetic oligonucleotide
  Description of Combined DNA/RNA Molecule: Synthetic oligonucleotide
guccaaagcaugauaauauucauaaau

SEQ ID NO: 116 - RNA, 27 nt, Artificial Sequence
  Description of Artificial Sequence: Synthetic oligonucleotide
  Description of Combined DNA/RNA Molecule: Synthetic oligonucleotide
gaguccaaagcaugauaauauucauaa

SEQ ID NO: 117 - RNA, 27 nt, Artificial Sequence
  Description of Artificial Sequence: Synthetic oligonucleotide
  Description of Combined DNA/RNA Molecule: Synthetic oligonucleotide
cagaguccaaagcaugauaauauucau

SEQ ID NO: 118 - RNA, 27 nt, Artificial Sequence
  Description of Artificial Sequence: Synthetic oligonucleotide
  Description of Combined DNA/RNA Molecule: Synthetic oligonucleotide
augaucagaguccaaagcaugauaaua

SEQ ID NO: 119 - RNA, 27 nt, Artificial Sequence
  Description of Artificial Sequence: Synthetic oligonucleotide
  Description of Combined DNA/RNA Molecule: Synthetic oligonucleotide
cagaugaucagaguccaaagcaugaua

SEQ ID NO: 120 - RNA, 27 nt, Artificial Sequence
  Description of Artificial Sequence: Synthetic oligonucleotide
  Description of Combined DNA/RNA Molecule: Synthetic oligonucleotide
ggucagaugaucagaguccaaagcaug

SEQ ID NO: 121 - RNA, 27 nt, Artificial Sequence
  Description of Artificial Sequence: Synthetic oligonucleotide
  Description of Combined DNA/RNA Molecule: Synthetic oligonucleotide
uuuggucagaugaucagaguccaaagc

SEQ ID NO: 122 - RNA, 27 nt, Artificial Sequence
  Description of Artificial Sequence: Synthetic oligonucleotide
  Description of Combined DNA/RNA Molecule: Synthetic oligonucleotide
gaugaguuuuggucagaugaucagagu

SEQ ID NO: 123 - RNA, 27 nt, Artificial Sequence
  Description of Artificial Sequence: Synthetic oligonucleotide
  Description of Combined DNA/RNA Molecule: Synthetic oligonucleotide
augaugaguuuuggucagaugaucaga

SEQ ID NO: 124 - RNA, 27 nt, Artificial Sequence
  Description of Artificial Sequence: Synthetic oligonucleotide
  Description of Combined DNA/RNA Molecule: Synthetic oligonucleotide
ucaugaugaguuuuggucagaugauca

SEQ ID NO: 125 - RNA, 27 nt, Artificial Sequence
  Description of Artificial Sequence: Synthetic oligonucleotide
  Description of Combined DNA/RNA Molecule: Synthetic oligonucleotide
acuuguccuuuaguaaacauaucauga

SEQ ID NO: 126 - RNA, 27 nt, Artificial Sequence
  Description of Artificial Sequence: Synthetic oligonucleotide
  Description of Combined DNA/RNA Molecule: Synthetic oligonucleotide
ugacuuguccuuuaguaaacauaucau

SEQ ID NO: 127 - RNA, 27 nt, Artificial Sequence
  Description of Artificial Sequence: Synthetic oligonucleotide
  Description of Combined DNA/RNA Molecule: Synthetic oligonucleotide
ggugacuuguccuuuaguaaacauauc

SEQ ID NO: 128 - RNA, 27 nt, Artificial Sequence
  Description of Artificial Sequence: Synthetic oligonucleotide
  Description of Combined DNA/RNA Molecule: Synthetic oligonucleotide
guggugacuuguccuuuaguaaacaua

SEQ ID NO: 129 - RNA, 27 nt, Artificial Sequence
  Description of Artificial Sequence: Synthetic oligonucleotide
  Description of Combined DNA/RNA Molecule: Synthetic oligonucleotide
cuguggugacuuguccuuuaguaaaca

SEQ ID NO: 130 - RNA, 27 nt, Artificial Sequence
  Description of Artificial Sequence: Synthetic oligonucleotide
  Description of Combined DNA/RNA Molecule: Synthetic oligonucleotide
uccuguggugacuuguccuuuaguaaa

SEQ ID NO: 131 - RNA, 27 nt, Artificial Sequence
  Description of Artificial Sequence: Synthetic oligonucleotide
  Description of Combined DNA/RNA Molecule: Synthetic oligonucleotide
uguccuguggugacuuguccuuuagua

SEQ ID NO: 132 - RNA, 27 nt, Artificial Sequence
  Description of Artificial Sequence: Synthetic oligonucleotide
  Description of Combined DNA/RNA Molecule: Synthetic oligonucleotide
acuguccuguggugacuuguccuuuag

SEQ ID NO: 133 - RNA, 27 nt, Artificial Sequence
  Description of Artificial Sequence: Synthetic oligonucleotide
  Description of Combined DNA/RNA Molecule: Synthetic oligonucleotide
guacuguccuguggugacuuguccuuu

SEQ ID NO: 134 - RNA, 27 nt, Artificial Sequence
  Description of Artificial Sequence: Synthetic oligonucleotide
  Description of Combined DNA/RNA Molecule: Synthetic oligonucleotide
cuguacuguccuguggugacuuguccu

SEQ ID NO: 135 - RNA, 27 nt, Artificial Sequence
  Description of Artificial Sequence: Synthetic oligonucleotide
  Description of Combined DNA/RNA Molecule: Synthetic oligonucleotide
uccuguacuguccuguggugacuuguc

SEQ ID NO: 136 - RNA, 27 nt, Artificial Sequence
  Description of Artificial Sequence: Synthetic oligonucleotide
  Description of Combined DNA/RNA Molecule: Synthetic oligonucleotide
cauccuguacuguccuguggugacuug

SEQ ID NO: 137 - RNA, 27 nt, Artificial Sequence
  Description of Artificial Sequence: Synthetic oligonucleotide
  Description of Combined DNA/RNA Molecule: Synthetic oligonucleotide
agcauccuguacuguccuguggugacu

SEQ ID NO: 138 - RNA, 27 nt, Artificial Sequence
  Description of Artificial Sequence: Synthetic oligonucleotide
  Description of Combined DNA/RNA Molecule: Synthetic oligonucleotide
caagcauccuguacuguccugugguga

SEQ ID NO: 139 - RNA, 27 nt, Artificial Sequence
  Description of Artificial Sequence: Synthetic oligonucleotide
  Description of Combined DNA/RNA Molecule: Synthetic oligonucleotide
ggcaagcauccuguacuguccuguggu

SEQ ID NO: 140 - RNA, 27 nt, Artificial Sequence
  Description of Artificial Sequence: Synthetic oligonucleotide
  Description of Combined DNA/RNA Molecule: Synthetic oligonucleotide
uuggcaagcauccuguacuguccugug

SEQ ID NO: 141 - RNA, 27 nt, Artificial Sequence
  Description of Artificial Sequence: Synthetic oligonucleotide
  Description of Combined DNA/RNA Molecule: Synthetic oligonucleotide
uuuuggcaagcauccuguacuguccug

SEQ ID NO: 142 - RNA, 27 nt, Artificial Sequence
  Description of Artificial Sequence: Synthetic oligonucleotide
  Description of Combined DNA/RNA Molecule: Synthetic oligonucleotide
ucuuuuggcaagcauccuguacugucc

SEQ ID NO: 143 - RNA, 27 nt, Artificial Sequence
  Description of Artificial Sequence: Synthetic oligonucleotide
  Description of Combined DNA/RNA Molecule: Synthetic oligonucleotide
ccucuuuuggcaagcauccuguacugu

SEQ ID NO: 144 - RNA, 27 nt, Artificial Sequence
  Description of Artificial Sequence: Synthetic oligonucleotide
  Description of Combined DNA/RNA Molecule: Synthetic oligonucleotide
caccucuuuuggcaagcauccuguacu

SEQ ID NO: 145 - RNA, 27 nt, Artificial Sequence
  Description of Artificial Sequence: Synthetic oligonucleotide
  Description of Combined DNA/RNA Molecule: Synthetic oligonucleotide
uccaccucuuuuggcaagcauccugua

SEQ ID NO: 146 - RNA, 27 nt, Artificial Sequence
  Description of Artificial Sequence: Synthetic oligonucleotide
  Description of Combined DNA/RNA Molecule: Synthetic oligonucleotide
uauccaccucuuuuggcaagcauccug

SEQ ID NO: 147 - RNA, 27 nt, Artificial Sequence
  Description of Artificial Sequence: Synthetic oligonucleotide
  Description of Combined DNA/RNA Molecule: Synthetic oligonucleotide
cauauccaccucuuuuggcaagcaucc

SEQ ID NO: 148 - RNA, 27 nt, Artificial Sequence
  Description of Artificial Sequence: Synthetic oligonucleotide
  Description of Combined DNA/RNA Molecule: Synthetic oligonucleotide
gacauauccaccucuuuuggcaagcau

SEQ ID NO: 149 - RNA, 27 nt, Artificial Sequence
  Description of Artificial Sequence: Synthetic oligonucleotide
  Description of Combined DNA/RNA Molecule: Synthetic oligonucleotide
cagacauauccaccucuuuuggcaagc

SEQ ID NO: 150 - RNA, 27 nt, Artificial Sequence
  Description of Artificial Sequence: Synthetic oligonucleotide
  Description of Combined DNA/RNA Molecule: Synthetic oligonucleotide
cccagacauauccaccucuuuuggcaa

SEQ ID NO: 151 - RNA, 27 nt, Artificial Sequence
  Description of Artificial Sequence: Synthetic oligonucleotide
  Description of Combined DNA/RNA Molecule: Synthetic oligonucleotide
aacccagacauauccaccucuuuuggc

SEQ ID NO: 152 - RNA, 27 nt, Artificial Sequence
  Description of Artificial Sequence: Synthetic oligonucleotide
  Description of Combined DNA/RNA Molecule: Synthetic oligonucleotide
ucaacccagacauauccaccucuuuug

SEQ ID NO: 153 - RNA, 27 nt, Artificial Sequence
  Description of Artificial Sequence: Synthetic oligonucleotide
  Description of Combined DNA/RNA Molecule: Synthetic oligonucleotide
uuucaacccagacauauccaccucuuu

SEQ ID NO: 154 - RNA, 27 nt, Artificial Sequence
  Description of Artificial Sequence: Synthetic oligonucleotide
  Description of Combined DNA/RNA Molecule: Synthetic oligonucleotide
aguuucaacccagacauauccaccucu

SEQ ID NO: 155 - RNA, 27 nt, Artificial Sequence
  Description of Artificial Sequence: Synthetic oligonucleotide
  Description of Combined DNA/RNA Molecule: Synthetic oligonucleotide
ugaguuucaacccagacauauccaccu

SEQ ID NO: 156 - RNA, 27 nt, Artificial Sequence
  Description of Artificial Sequence: Synthetic oligonucleotide
  Description of Combined DNA/RNA Molecule: Synthetic oligonucleotide
cuugaguuucaacccagacauauccac

SEQ ID NO: 157 - RNA, 27 nt, Artificial Sequence
  Description of Artificial Sequence: Synthetic oligonucleotide
  Description of Combined DNA/RNA Molecule: Synthetic oligonucleotide
ugcuugaguuucaacccagacauaucc

SEQ ID NO: 158 - RNA, 27 nt, Artificial Sequence
  Description of Artificial Sequence: Synthetic oligonucleotide
  Description of Combined DNA/RNA Molecule: Synthetic oligonucleotide
guugcuugaguuucaacccagacauau

SEQ ID NO: 159 - RNA, 27 nt, Artificial Sequence
  Description of Artificial Sequence: Synthetic oligonucleotide
  Description of Combined DNA/RNA Molecule: Synthetic oligonucleotide
caguugcuugaguuucaacccagacau

SEQ ID NO: 160 - RNA, 27 nt, Artificial Sequence
  Description of Artificial Sequence: Synthetic oligonucleotide
  Description of Combined DNA/RNA Molecule: Synthetic oligonucleotide
gacaguugcuugaguuucaacccagac

SEQ ID NO: 161 - RNA, 27 nt, Artificial Sequence
  Description of Artificial Sequence: Synthetic oligonucleotide
  Description of Combined DNA/RNA Molecule: Synthetic oligonucleotide
augacaguugcuugaguuucaacccag

SEQ ID NO: 162 - RNA, 27 nt, Artificial Sequence
  Description of Artificial Sequence: Synthetic oligonucleotide
  Description of Combined DNA/RNA Molecule: Synthetic oligonucleotide
auaugacaguugcuugaguuucaaccc

SEQ ID NO: 163 - RNA, 27 nt, Artificial Sequence
  Description of Artificial Sequence: Synthetic oligonucleotide
  Description of Combined DNA/RNA Molecule: Synthetic oligonucleotide
auauaugacaguugcuugaguuucaac

SEQ ID NO: 164 - RNA, 27 nt, Artificial Sequence
  Description of Artificial Sequence: Synthetic oligonucleotide
  Description of Combined DNA/RNA Molecule: Synthetic oligonucleotide
uuauauaugacaguugcuugaguuuca

SEQ ID NO: 165 - RNA, 27 nt, Artificial Sequence
  Description of Artificial Sequence: Synthetic oligonucleotide
  Description of Combined DNA/RNA Molecule: Synthetic oligonucleotide
uguuauauaugacaguugcuugaguuu

SEQ ID NO: 166 - RNA, 27 nt, Artificial Sequence
  Description of Artificial Sequence: Synthetic oligonucleotide
  Description of Combined DNA/RNA Molecule: Synthetic oligonucleotide
gguguuauauaugacaguugcuugagu

SEQ ID NO: 167 - RNA, 27 nt, Artificial Sequence
  Description of Artificial Sequence: Synthetic oligonucleotide
  Description of Combined DNA/RNA Molecule: Synthetic oligonucleotide
uugguguuauauaugacaguugcuuga

SEQ ID NO: 168 - RNA, 27 nt, Artificial Sequence
  Description of Artificial Sequence: Synthetic oligonucleotide
  Description of Combined DNA/RNA Molecule: Synthetic oligonucleotide
aucaagucgugcugaauaauaccacuc

SEQ ID NO: 169 - RNA, 27 nt, Artificial Sequence
  Description of Artificial Sequence: Synthetic oligonucleotide
  Description of Combined DNA/RNA Molecule: Synthetic oligonucleotide
aaaucaagucgugcugaauaauaccac

SEQ ID NO: 170 - RNA, 27 nt, Artificial Sequence
  Description of Artificial Sequence: Synthetic oligonucleotide
  Description of Combined DNA/RNA Molecule: Synthetic oligonucleotide
gaaaaucaagucgugcugaauaauacc

SEQ ID NO: 171 - RNA, 27 nt, Artificial Sequence
  Description of Artificial Sequence: Synthetic oligonucleotide
  Description of Combined DNA/RNA Molecule: Synthetic oligonucleotide
gagaaaaucaagucgugcugaauaaua

SEQ ID NO: 172 - RNA, 27 nt, Artificial Sequence
  Description of Artificial Sequence: Synthetic oligonucleotide
  Description of Combined DNA/RNA Molecule: Synthetic oligonucleotide
gggagaaaaucaagucgugcugaauaa

SEQ ID NO: 173 - RNA, 27 nt, Artificial Sequence
  Description of Artificial Sequence: Synthetic oligonucleotide
  Description of Combined DNA/RNA Molecule: Synthetic oligonucleotide
aagggagaaaaucaagucgugcugaau

SEQ ID NO: 174 - RNA, 27 nt, Artificial Sequence
  Description of Artificial Sequence: Synthetic oligonucleotide
  Description of Combined DNA/RNA Molecule: Synthetic oligonucleotide
ugaagggagaaaaucaagucgugcuga

SEQ ID NO: 175 - RNA, 27 nt, Artificial Sequence
  Description of Artificial Sequence: Synthetic oligonucleotide
  Description of Combined DNA/RNA Molecule: Synthetic oligonucleotide
guugaagggagaaaaucaagucgugcu

SEQ ID NO: 176 - RNA, 27 nt, Artificial Sequence
  Description of Artificial Sequence: Synthetic oligonucleotide
  Description of Combined DNA/RNA Molecule: Synthetic oligonucleotide
uuguugaagggagaaaaucaagucgug

SEQ ID NO: 177 - RNA, 27 nt, Artificial Sequence
  Description of Artificial Sequence: Synthetic oligonucleotide
  Description of Combined DNA/RNA Molecule: Synthetic oligonucleotide
guuuguugaagggagaaaaucaagucg

SEQ ID NO: 178 - RNA, 27 nt, Artificial Sequence
  Description of Artificial Sequence: Synthetic oligonucleotide
  Description of Combined DNA/RNA Molecule: Synthetic oligonucleotide
cuguuuguugaagggagaaaaucaagu

SEQ ID NO: 179 - RNA, 27 nt, Artificial Sequence
  Description of Artificial Sequence: Synthetic oligonucleotide
  Description of Combined DNA/RNA Molecule: Synthetic oligonucleotide
uucuguuuguugaagggagaaaaucaa

SEQ ID NO: 180 - RNA, 27 nt, Artificial Sequence
  Description of Artificial Sequence: Synthetic oligonucleotide
  Description of Combined DNA/RNA Molecule: Synthetic oligonucleotide
cauucuguuuguugaagggagaaaauc

SEQ ID NO: 181 - RNA, 27 nt, Artificial Sequence
  Description of Artificial Sequence: Synthetic oligonucleotide
  Description of Combined DNA/RNA Molecule: Synthetic oligonucleotide
cacauucuguuuguugaagggagaaaa

SEQ ID NO: 182 - RNA, 27 nt, Artificial Sequence
  Description of Artificial Sequence: Synthetic oligonucleotide
  Description of Combined DNA/RNA Molecule: Synthetic oligonucleotide
gucauuuucauaucugaagauucaacc

SEQ ID NO: 183 - RNA, 27 nt, Artificial Sequence
  Description of Artificial Sequence: Synthetic oligonucleotide
  Description of Combined DNA/RNA Molecule: Synthetic oligonucleotide
guaucuucugauucaacuuuggugaau

SEQ ID NO: 184 - RNA, 27 nt, Artificial Sequence
  Description of Artificial Sequence: Synthetic oligonucleotide
  Description of Combined DNA/RNA Molecule: Synthetic oligonucleotide
guuugucaaagaggcuacuuguaucuu

SEQ ID NO: 185 - RNA, 27 nt, Artificial Sequence
  Description of Artificial Sequence: Synthetic oligonucleotide
  Description of Combined DNA/RNA Molecule: Synthetic oligonucleotide
cugccaaaaucuaaagauaugauugug

SEQ ID NO: 186 - RNA, 27 nt, Artificial Sequence
  Description of Artificial Sequence: Synthetic oligonucleotide
  Description of Combined DNA/RNA Molecule: Synthetic oligonucleotide
cauuacaucauuauauaaugguacuuc

SEQ ID NO: 187 - RNA, 27 nt, Artificial Sequence
  Description of Artificial Sequence: Synthetic oligonucleotide
  Description of Combined DNA/RNA Molecule: Synthetic oligonucleotide
gggagcauuacaucauuauauaauggu

SEQ ID NO: 188 - RNA, 27 nt, Artificial Sequence
  Description of Artificial Sequence: Synthetic oligonucleotide
  Description of Combined DNA/RNA Molecule: Synthetic oligonucleotide
ggcuuuggcguuucagcgguggguaau

SEQ ID NO: 189 - RNA, 27 nt, Artificial Sequence
  Description of Artificial Sequence: Synthetic oligonucleotide
  Description of Combined DNA/RNA Molecule: Synthetic oligonucleotide
ucagcacuacuucgaaguggcuuuggc

SEQ ID NO: 190 - RNA, 27 nt, Artificial Sequence
  Description of Artificial Sequence: Synthetic oligonucleotide
  Description of Combined DNA/RNA Molecule: Synthetic oligonucleotide
ggucagcacuacuucgaaguggcuuug

SEQ ID NO: 191 - RNA, 27 nt, Artificial Sequence
  Description of Artificial Sequence: Synthetic oligonucleotide
  Description of Combined DNA/RNA Molecule: Synthetic oligonucleotide
agggucagcacuacuucgaaguggcuu

SEQ ID NO: 192 - RNA, 27 nt, Artificial Sequence
  Description of Artificial Sequence: Synthetic oligonucleotide
  Description of Combined DNA/RNA Molecule: Synthetic oligonucleotide
gcagggucagcacuacuucgaaguggc

SEQ ID NO: 193 - RNA, 27 nt, Artificial Sequence
  Description of Artificial Sequence: Synthetic oligonucleotide
  Description of Combined DNA/RNA Molecule: Synthetic oligonucleotide
gagugcagggucagcacuacuucgaag

SEQ ID NO: 194 - RNA, 27 nt, Artificial Sequence
  Description of Artificial Sequence: Synthetic oligonucleotide
  Description of Combined DNA/RNA Molecule: Synthetic oligonucleotide
uugguucuaauuuuaaugcaacuucuu

SEQ ID NO: 195 - RNA, 27 nt, Artificial Sequence
  Description of Artificial Sequence: Synthetic oligonucleotide
  Description of Combined DNA/RNA Molecule: Synthetic oligonucleotide
ggugaacuuugucuagugcuuccaucg

SEQ ID NO: 196 - RNA, 27 nt, Artificial Sequence
  Description of Artificial Sequence: Synthetic oligonucleotide
  Description of Combined DNA/RNA Molecule: Synthetic oligonucleotide
caggugaacuuugucuagugcuuccau

SEQ ID NO: 197 - RNA, 27 nt, Artificial Sequence
  Description of Artificial Sequence: Synthetic oligonucleotide
  Description of Combined DNA/RNA Molecule: Synthetic oligonucleotide
cucaggugaacuuugucuagugcuucc

SEQ ID NO: 198 - RNA, 27 nt, Artificial Sequence
  Description of Artificial Sequence: Synthetic oligonucleotide
  Description of Combined DNA/RNA Molecule: Synthetic oligonucleotide
ggcucaggugaacuuugucuagugcuu

SEQ ID NO: 199 - RNA, 27 nt, Artificial Sequence
  Description of Artificial Sequence: Synthetic oligonucleotide
  Description of Combined DNA/RNA Molecule: Synthetic oligonucleotide
uaggcucaggugaacuuugucuagugc

SEQ ID NO: 200 - RNA, 27 nt, Artificial Sequence
  Description of Artificial Sequence: Synthetic oligonucleotide
  Description of Combined DNA/RNA Molecule: Synthetic oligonucleotide
auuaggcucaggugaacuuugucuagu

SEQ ID NO: 201 - RNA, 27 nt, Artificial Sequence
  Description of Artificial Sequence: Synthetic oligonucleotide
  Description of Combined DNA/RNA Molecule: Synthetic oligonucleotide
uauccacauaaaaacaauauucacugg

SEQ ID NO: 202 - RNA, 27 nt, Artificial Sequence
  Description of Artificial Sequence: Synthetic oligonucleotide
  Description of Combined DNA/RNA Molecule: Synthetic oligonucleotide
cauaucacuauccacauaaaaacaaua

SEQ ID NO: 203 - RNA, 27 nt, Artificial Sequence
  Description of Artificial Sequence: Synthetic oligonucleotide
  Description of Combined DNA/RNA Molecule: Synthetic oligonucleotide
ugucuucagcaaaaaguuuuucuacca

SEQ ID NO: 204 - RNA, 27 nt, Artificial Sequence
  Description of Artificial Sequence: Synthetic oligonucleotide
  Description of Combined DNA/RNA Molecule: Synthetic oligonucleotide
ucaucauccauugggauauagggagcu

SEQ ID NO: 205 - RNA, 27 nt, Artificial Sequence
  Description of Artificial Sequence: Synthetic oligonucleotide
  Description of Combined DNA/RNA Molecule: Synthetic oligonucleotide
agucaucauccauugggauauagggag

SEQ ID NO: 206 - RNA, 27 nt, Artificial Sequence
  Description of Artificial Sequence: Synthetic oligonucleotide
  Description of Combined DNA/RNA Molecule: Synthetic oligonucleotide
gaagucaucauccauugggauauaggg

SEQ ID NO: 207 - RNA, 27 nt, Artificial Sequence
  Description of Artificial Sequence: Synthetic oligonucleotide
  Description of Combined DNA/RNA Molecule: Synthetic oligonucleotide
uggaagucaucauccauugggauauag

SEQ ID NO: 208 - RNA, 27 nt, Artificial Sequence
  Description of Artificial Sequence: Synthetic oligonucleotide
  Description of Combined DNA/RNA Molecule: Synthetic oligonucleotide
cugcuuucuaauggugacaacugaucg

SEQ ID NO: 209 - RNA, 27 nt, Artificial Sequence
  Description of Artificial Sequence: Synthetic oligonucleotide
  Description of Combined DNA/RNA Molecule: Synthetic oligonucleotide
cuugcgcuuucagggcuugcggaacug

SEQ ID NO: 210 - RNA, 27 nt, Artificial Sequence
  Description of Artificial Sequence: Synthetic oligonucleotide
  Description of Combined DNA/RNA Molecule: Synthetic oligonucleotide
gacuugcgcuuucagggcuugcggaac

SEQ ID NO: 211 - RNA, 27 nt, Artificial Sequence
  Description of Artificial Sequence: Synthetic oligonucleotide
  Description of Combined DNA/RNA Molecule: Synthetic oligonucleotide
uuugucacuguuuuuaauucaucagug

SEQ ID NO: 212 - RNA, 27 nt, Artificial Sequence
  Description of Artificial Sequence: Synthetic oligonucleotide
  Description of Combined DNA/RNA Molecule: Synthetic oligonucleotide
gaugcaaucaauauuuuaaugucuucc

SEQ ID NO: 213 - RNA, 27 nt, Artificial Sequence
  Description of Artificial Sequence: Synthetic oligonucleotide
  Description of Combined DNA/RNA Molecule: Synthetic oligonucleotide
gauuuuucugucuguucuaugacuccu

SEQ ID NO: 214 - RNA, 27 nt, Artificial Sequence
  Description of Artificial Sequence: Synthetic oligonucleotide
  Description of Combined DNA/RNA Molecule: Synthetic oligonucleotide
cugagcauucugcaaagcuaguaucuu

SEQ ID NO: 215 - RNA, 27 nt, Artificial Sequence
  Description of Artificial Sequence: Synthetic oligonucleotide
  Description of Combined DNA/RNA Molecule: Synthetic oligonucleotide
cauguuccauuuuucgcuuucucugag

SEQ ID NO: 216 - RNA, 27 nt, Artificial Sequence
  Description of Artificial Sequence: Synthetic oligonucleotide
  Description of Combined DNA/RNA Molecule: Synthetic oligonucleotide
gaaccaucauguuccauuuuucgcuuu

SEQ ID NO: 217 - RNA, 27 nt, Artificial Sequence
  Description of Artificial Sequence: Synthetic oligonucleotide
  Description of Combined DNA/RNA Molecule: Synthetic oligonucleotide
gugaaccaucauguuccauuuuucgcu

SEQ ID NO: 218 - RNA, 27 nt, Artificial Sequence
  Description of Artificial Sequence: Synthetic oligonucleotide
  Description of Combined DNA/RNA Molecule: Synthetic oligonucleotide
uaauaauguuccaauuccuacugcuug

SEQ ID NO: 219 - RNA, 27 nt, Artificial Sequence
  Description of Artificial Sequence: Synthetic oligonucleotide
  Description of Combined DNA/RNA Molecule: Synthetic oligonucleotide
cuccauuccauucuguucacuagauuu

SEQ ID NO: 220 - RNA, 27 nt, Artificial Sequence
  Description of Artificial Sequence: Synthetic oligonucleotide
  Description of Combined DNA/RNA Molecule: Synthetic oligonucleotide
aggguauuaaaauaauugucuuuugcu

SEQ ID NO: 221 - RNA, 27 nt, Artificial Sequence
  Description of Artificial Sequence: Synthetic oligonucleotide
  Description of Combined DNA/RNA Molecule: Synthetic oligonucleotide
aacuggucagcugugguaauccacuuu

SEQ ID NO: 222 - RNA, 27 nt, Artificial Sequence
  Description of Artificial Sequence: Synthetic oligonucleotide
  Description of Combined DNA/RNA Molecule: Synthetic oligonucleotide
auaacuggucagcugugguaauccacu

SEQ ID NO: 223 - RNA, 27 nt, Artificial Sequence
  Description of Artificial Sequence: Synthetic oligonucleotide
  Description of Combined DNA/RNA Molecule: Synthetic oligonucleotide
ucauaacuggucagcugugguaaucca

SEQ ID NO: 224 - RNA, 27 nt, Artificial Sequence
  Description of Artificial Sequence: Synthetic oligonucleotide
  Description of Combined DNA/RNA Molecule: Synthetic oligonucleotide
aaucauaacuggucagcugugguaauc

SEQ ID NO: 225 - RNA, 27 nt, Artificial Sequence
  Description of Artificial Sequence: Synthetic oligonucleotide
  Description of Combined DNA/RNA Molecule: Synthetic oligonucleotide
guauaggagcauuaacuucacaaucau

SEQ ID NO: 226 - RNA, 27 nt, Artificial Sequence
  Description of Artificial Sequence: Synthetic oligonucleotide
  Description of Combined DNA/RNA Molecule: Synthetic oligonucleotide
gcaguagguuucugcugccuuguauag

SEQ ID NO: 227 - RNA, 27 nt, Artificial Sequence
  Description of Artificial Sequence: Synthetic oligonucleotide
  Description of Combined DNA/RNA Molecule: Synthetic oligonucleotide
cugcaguagguuucugcugccuuguau

SEQ ID NO: 228 - RNA, 27 nt, Artificial Sequence
  Description of Artificial Sequence: Synthetic oligonucleotide
  Description of Combined DNA/RNA Molecule: Synthetic oligonucleotide
cccugcaguagguuucugcugccuugu

SEQ ID NO: 229 - RNA, 27 nt, Artificial Sequence
  Description of Artificial Sequence: Synthetic oligonucleotide
  Description of Combined DNA/RNA Molecule: Synthetic oligonucleotide
cacccugcaguagguuucugcugccuu

SEQ ID NO: 230 - RNA, 27 nt, Artificial Sequence
  Description of Artificial Sequence: Synthetic oligonucleotide
  Description of Combined DNA/RNA Molecule: Synthetic oligonucleotide
uucacccugcaguagguuucugcugcc

SEQ ID NO: 231 - RNA, 27 nt, Artificial Sequence
  Description of Artificial Sequence: Synthetic oligonucleotide
  Description of Combined DNA/RNA Molecule: Synthetic oligonucleotide
ucuucacccugcaguagguuucugcug

SEQ ID NO: 232 - RNA, 27 nt, Artificial Sequence
  Description of Artificial Sequence: Synthetic oligonucleotide
  Description of Combined DNA/RNA Molecule: Synthetic oligonucleotide
auucuucacccugcaguagguuucugc

SEQ ID NO: 233 - RNA, 27 nt, Artificial Sequence
  Description of Artificial Sequence: Synthetic oligonucleotide
  Description of Combined DNA/RNA Molecule: Synthetic oligonucleotide
uaauucuucacccugcaguagguuucu

SEQ ID NO: 234 - RNA, 27 nt, Artificial Sequence
  Description of Artificial Sequence: Synthetic oligonucleotide
  Description of Combined DNA/RNA Molecule: Synthetic oligonucleotide
aguaauucuucacccugcaguagguuu

SEQ ID NO: 235 - RNA, 27 nt, Artificial Sequence
  Description of Artificial Sequence: Synthetic oligonucleotide
  Description of Combined DNA/RNA Molecule: Synthetic oligonucleotide
ugaguaauucuucacccugcaguaggu

SEQ ID NO: 236 - RNA, 27 nt, Artificial Sequence
  Description of Artificial Sequence: Synthetic oligonucleotide
  Description of Combined DNA/RNA Molecule: Synthetic oligonucleotide
ucugaguaauucuucacccugcaguag

SEQ ID NO: 237 - RNA, 27 nt, Artificial Sequence
  Description of Artificial Sequence: Synthetic oligonucleotide
  Description of Combined DNA/RNA Molecule: Synthetic oligonucleotide
gcucugaguaauucuucacccugcagu

SEQ ID NO: 238 - RNA, 27 nt, Artificial Sequence
  Description of Artificial Sequence: Synthetic oligonucleotide
  Description of Combined DNA/RNA Molecule: Synthetic oligonucleotide
aagcucugaguaauucuucacccugca

SEQ ID NO: 239 - RNA, 27 nt, Artificial Sequence
  Description of Artificial Sequence: Synthetic oligonucleotide
  Description of Combined DNA/RNA Molecule: Synthetic oligonucleotide
caaagcucugaguaauucuucacccug

SEQ ID NO: 240 - RNA, 27 nt, Artificial Sequence
  Description of Artificial Sequence: Synthetic oligonucleotide
  Description of Combined DNA/RNA Molecule: Synthetic oligonucleotide
uccaaagcucugaguaauucuucaccc

SEQ ID NO: 241 - RNA, 27 nt, Artificial Sequence
  Description of Artificial Sequence: Synthetic oligonucleotide
  Description of Combined DNA/RNA Molecule: Synthetic oligonucleotide
gauccaaagcucugaguaauucuucac

SEQ ID NO: 242 - RNA, 27 nt, Artificial Sequence
  Description of Artificial Sequence: Synthetic oligonucleotide
  Description of Combined DNA/RNA Molecule: Synthetic oligonucleotide
uugauccaaagcucugaguaauucuuc

SEQ ID NO: 243 - RNA, 27 nt, Artificial Sequence
  Description of Artificial Sequence: Synthetic oligonucleotide
  Description of Combined DNA/RNA Molecule: Synthetic oligonucleotide
acuugauccaaagcucugaguaauucu

SEQ ID NO: 244 - RNA, 27 nt, Artificial Sequence
  Description of Artificial Sequence: Synthetic oligonucleotide
  Description of Combined DNA/RNA Molecule: Synthetic oligonucleotide
uaacuugauccaaagcucugaguaauu

SEQ ID NO: 245 - RNA, 27 nt, Artificial Sequence
  Description of Artificial Sequence: Synthetic oligonucleotide
  Description of Combined DNA/RNA Molecule: Synthetic oligonucleotide
guuaacuugauccaaagcucugaguaa

SEQ ID NO: 246 - RNA, 27 nt, Artificial Sequence
  Description of Artificial Sequence: Synthetic oligonucleotide
  Description of Combined DNA/RNA Molecule: Synthetic oligonucleotide
caguuaacuugauccaaagcucugagu

SEQ ID NO: 247 - RNA, 27 nt, Artificial Sequence
  Description of Artificial Sequence: Synthetic oligonucleotide
  Description of Combined DNA/RNA Molecule: Synthetic oligonucleotide
cucaguuaacuugauccaaagcucuga

SEQ ID NO: 248 - RNA, 27 nt, Artificial Sequence
  Description of Artificial Sequence: Synthetic oligonucleotide
  Description of Combined DNA/RNA Molecule: Synthetic oligonucleotide
agcucaguuaacuugauccaaagcucu

SEQ ID NO: 249 - RNA, 27 nt, Artificial Sequence
  Description of Artificial Sequence: Synthetic oligonucleotide
  Description of Combined DNA/RNA Molecule: Synthetic oligonucleotide
aaagcucaguuaacuugauccaaagcu

SEQ ID NO: 250 - RNA, 27 nt, Artificial Sequence
  Description of Artificial Sequence: Synthetic oligonucleotide
  Description of Combined DNA/RNA Molecule: Synthetic oligonucleotide
aaaaagcucaguuaacuugauccaaag

SEQ ID NO: 251 - RNA, 27 nt, Artificial Sequence
  Description of Artificial Sequence: Synthetic oligonucleotide
  Description of Combined DNA/RNA Molecule: Synthetic oligonucleotide
aagaaaaagcucaguuaacuugaucca

SEQ ID NO: 252 - RNA, 27 nt, Artificial Sequence
  Description of Artificial Sequence: Synthetic oligonucleotide
  Description of Combined DNA/RNA Molecule: Synthetic oligonucleotide
ggaaugaaauuaagaaaaagcucaguu

SEQ ID NO: 253 - RNA, 27 nt, Artificial Sequence
  Description of Artificial Sequence: Synthetic oligonucleotide
  Description of Combined DNA/RNA Molecule: Synthetic oligonucleotide
aaaaggaaugaaauuaagaaaaagcuc

SEQ ID NO: 254 - RNA, 27 nt, Artificial Sequence
  Description of Artificial Sequence: Synthetic oligonucleotide
  Description of Combined DNA/RNA Molecule: Synthetic oligonucleotide
guguccaaaaaaaggaaugaaauuaag

SEQ ID NO: 255 - RNA, 27 nt, Artificial Sequence
  Description of Artificial Sequence: Synthetic oligonucleotide
  Description of Combined DNA/RNA Molecule: Synthetic oligonucleotide
ccaccaguguccaaaaaaaggaaugaa

SEQ ID NO: 256 - RNA, 27 nt, Artificial Sequence
  Description of Artificial Sequence: Synthetic oligonucleotide
  Description of Combined DNA/RNA Molecule: Synthetic oligonucleotide
guaaugagccaccaguguccaaaaaaa

SEQ ID NO: 257 - RNA, 27 nt, Artificial Sequence
  Description of Artificial Sequence: Synthetic oligonucleotide
  Description of Combined DNA/RNA Molecule: Synthetic oligonucleotide
agguaaugagccaccaguguccaaaaa

SEQ ID NO: 258 - RNA, 27 nt, Artificial Sequence
  Description of Artificial Sequence: Synthetic oligonucleotide
  Description of Combined DNA/RNA Molecule: Synthetic oligonucleotide
gauguagaaaauauaaauagacugcuu

SEQ ID NO: 259 - RNA, 27 nt, Artificial Sequence
  Description of Artificial Sequence: Synthetic oligonucleotide
  Description of Combined DNA/RNA Molecule: Synthetic oligonucleotide
uagauguagaaaauauaaauagacugc

SEQ ID NO: 260 - RNA, 27 nt, Artificial Sequence
  Description of Artificial Sequence: Synthetic oligonucleotide
  Description of Combined DNA/RNA Molecule: Synthetic oligonucleotide
aaaauuagauguagaaaauauaaauag

SEQ ID NO: 261 - RNA, 27 nt, Artificial Sequence
  Description of Artificial Sequence: Synthetic oligonucleotide
  Description of Combined DNA/RNA Molecule: Synthetic oligonucleotide
uuguagccaggcuucuaaaauuagaug

SEQ ID NO: 262 - RNA, 27 nt, Artificial Sequence
  Description of Artificial Sequence: Synthetic oligonucleotide
  Description of Combined DNA/RNA Molecule: Synthetic oligonucleotide
uauuguagccaggcuucuaaaauuaga

SEQ ID NO: 263 - RNA, 27 nt, Artificial Sequence
  Description of Artificial Sequence: Synthetic oligonucleotide
  Description of Combined DNA/RNA Molecule: Synthetic oligonucleotide
aguauuguagccaggcuucuaaaauua

SEQ ID NO: 264 - RNA, 27 nt, Artificial Sequence
  Description of Artificial Sequence: Synthetic oligonucleotide
  Description of Combined DNA/RNA Molecule: Synthetic oligonucleotide
gcaguauuguagccaggcuucuaaaau

SEQ ID NO: 265 - RNA, 27 nt, Artificial Sequence
  Description of Artificial Sequence: Synthetic oligonucleotide
  Description of Combined DNA/RNA Molecule: Synthetic oligonucleotide
gugcaguauuguagccaggcuucuaaa

SEQ ID NO: 266 - RNA, 27 nt, Artificial Sequence
  Description of Artificial Sequence: Synthetic oligonucleotide
  Description of Combined DNA/RNA Molecule: Synthetic oligonucleotide
uugugcaguauuguagccaggcuucua

SEQ ID NO: 267 - RNA, 27 nt, Artificial Sequence
  Description of Artificial Sequence: Synthetic oligonucleotide
  Description of Combined DNA/RNA Molecule: Synthetic oligonucleotide
guuugugcaguauuguagccaggcuuc

SEQ ID NO: 268 - RNA, 27 nt, Artificial Sequence
  Description of Artificial Sequence: Synthetic oligonucleotide
  Description of Combined DNA/RNA Molecule: Synthetic oligonucleotide
aaguuugugcaguauuguagccaggcu

SEQ ID NO: 269 - RNA, 27 nt, Artificial Sequence
  Description of Artificial Sequence: Synthetic oligonucleotide
  Description of Combined DNA/RNA Molecule: Synthetic oligonucleotide
ccaaguuugugcaguauuguagccagg

SEQ ID NO: 270 - RNA, 27 nt, Artificial Sequence
  Description of Artificial Sequence: Synthetic oligonucleotide
  Description of Combined DNA/RNA Molecule: Synthetic oligonucleotide
aaccaaguuugugcaguauuguagcca

SEQ ID NO: 271 - RNA, 27 nt, Artificial Sequence
  Description of Artificial Sequence: Synthetic oligonucleotide
  Description of Combined DNA/RNA Molecule: Synthetic oligonucleotide
uaaaaaagagcauuaauguaaauuaag

SEQ ID NO: 272 - RNA, 27 nt, Artificial Sequence
  Description of Artificial Sequence: Synthetic oligonucleotide
  Description of Combined DNA/RNA Molecule: Synthetic oligonucleotide
aagaacauacuaaaaaagagcauuaau

SEQ ID NO: 273 - RNA, 27 nt, Artificial Sequence
  Description of Artificial Sequence: Synthetic oligonucleotide
  Description of Combined DNA/RNA Molecule: Synthetic oligonucleotide
uaaagaacauacuaaaaaagagcauua

SEQ ID NO: 274 - RNA, 27 nt, Artificial Sequence
  Description of Artificial Sequence: Synthetic oligonucleotide
  Description of Combined DNA/RNA Molecule: Synthetic oligonucleotide
uuaaagaacauacuaaaaaagagcauu

SEQ ID NO: 275 - RNA, 27 nt, Artificial Sequence
  Description of Artificial Sequence: Synthetic oligonucleotide
  Description of Combined DNA/RNA Molecule: Synthetic oligonucleotide
gauccagcauuaaagaacauacuaaaa

SEQ ID NO: 276 - RNA, 27 nt, Artificial Sequence
  Description of Artificial Sequence: Synthetic oligonucleotide
  Description of Combined DNA/RNA Molecule: Synthetic oligonucleotide
cugugauccagcauuaaagaacauacu

SEQ ID NO: 277 - RNA, 27 nt, Artificial Sequence
  Description of Artificial Sequence: Synthetic oligonucleotide
  Description of Combined DNA/RNA Molecule: Synthetic oligonucleotide
gagcugucugugauccagcauuaaaga

SEQ ID NO: 278 - RNA, 27 nt, Artificial Sequence
  Description of Artificial Sequence: Synthetic oligonucleotide
  Description of Combined DNA/RNA Molecule: Synthetic oligonucleotide
aaaaugagcugucugugauccagcauu

SEQ ID NO: 279 - RNA, 27 nt, Artificial Sequence
  Description of Artificial Sequence: Synthetic oligonucleotide
  Description of Combined DNA/RNA Molecule: Synthetic oligonucleotide
aauaccaaaaaacugagaaaaugagcu

SEQ ID NO: 280 - RNA, 27 nt, Artificial Sequence
  Description of Artificial Sequence: Synthetic oligonucleotide
  Description of Combined DNA/RNA Molecule: Synthetic oligonucleotide
auaaauaaauaaaaaggugcauuuuuu

SEQ ID NO: 281 - RNA, 27 nt, Artificial Sequence
  Description of Artificial Sequence: Synthetic oligonucleotide
  Description of Combined DNA/RNA Molecule: Synthetic oligonucleotide
aaauaaauaaauaaaaaggugcauuuu

SEQ ID NO: 282 - RNA, 27 nt, Artificial Sequence
  Description of Artificial Sequence: Synthetic oligonucleotide
  Description of Combined DNA/RNA Molecule: Synthetic oligonucleotide
aaaaauaaauaaauaaaaaggugcauu

SEQ ID NO: 283 - RNA, 27 nt, Artificial Sequence
  Description of Artificial Sequence: Synthetic oligonucleotide
  Description of Combined DNA/RNA Molecule: Synthetic oligonucleotide
ccaaaaauaaauaaauaaaaaggugca

SEQ ID NO: 284 - RNA, 27 nt, Artificial Sequence
  Description of Artificial Sequence: Synthetic oligonucleotide
  Description of Combined DNA/RNA Molecule: Synthetic oligonucleotide
agccaaaaauaaauaaauaaaaaggug

SEQ ID NO: 285 - RNA, 27 nt, Artificial Sequence
  Description of Artificial Sequence: Synthetic oligonucleotide
  Description of Combined DNA/RNA Molecule: Synthetic oligonucleotide
cuagccaaaaauaaauaaauaaaaagg

SEQ ID NO: 286 - RNA, 27 nt, Artificial Sequence
  Description of Artificial Sequence: Synthetic oligonucleotide
  Description of Combined DNA/RNA Molecule: Synthetic oligonucleotide
cccuagccaaaaauaaauaaauaaaaa

SEQ ID NO: 287 - RNA, 27 nt, Artificial Sequence
  Description of Artificial Sequence: Synthetic oligonucleotide
  Description of Combined DNA/RNA Molecule: Synthetic oligonucleotide
caucuucuuaaaaauaauucgaaaaag

SEQ ID NO: 288 - RNA, 27 nt, Artificial Sequence
  Description of Artificial Sequence: Synthetic oligonucleotide
  Description of Combined DNA/RNA Molecule: Synthetic oligonucleotide
cugccuucuuacaaaaauuauauuggc

SEQ ID NO: 289 - RNA, 27 nt, Artificial Sequence
  Description of Artificial Sequence: Synthetic oligonucleotide
  Description of Combined DNA/RNA Molecule: Synthetic oligonucleotide
uuuucaacugccuaugaucaugaugaa

SEQ ID NO: 290 - RNA, 27 nt, Artificial Sequence
  Description of Artificial Sequence: Synthetic oligonucleotide
  Description of Combined DNA/RNA Molecule: Synthetic oligonucleotide
auuuuucaacugccuaugaucaugaug

SEQ ID NO: 291 - RNA, 27 nt, Artificial Sequence
  Description of Artificial Sequence: Synthetic oligonucleotide
  Description of Combined DNA/RNA Molecule: Synthetic oligonucleotide
aaauuuuucaacugccuaugaucauga

SEQ ID NO: 292 - RNA, 27 nt, Artificial Sequence
  Description of Artificial Sequence: Synthetic oligonucleotide
  Description of Combined DNA/RNA Molecule: Synthetic oligonucleotide
aaaaauuuuucaacugccuaugaucau

SEQ ID NO: 293 - RNA, 27 nt, Artificial Sequence
  Description of Artificial Sequence: Synthetic oligonucleotide
  Description of Combined DNA/RNA Molecule: Synthetic oligonucleotide
aaaaaaagguguaaaaauuuuucaacu

SEQ ID NO: 294 - RNA, 27 nt, Artificial Sequence
  Description of Artificial Sequence: Synthetic oligonucleotide
  Description of Combined DNA/RNA Molecule: Synthetic oligonucleotide
uauuuauguaaaaugugaaaaaaaagg

SEQ ID NO: 295 - RNA, 27 nt, Artificial Sequence
  Description of Artificial Sequence: Synthetic oligonucleotide
  Description of Combined DNA/RNA Molecule: Synthetic oligonucleotide
aauauauugugcaauuguggcuaccac

SEQ ID NO: 296 - RNA, 27 nt, Artificial Sequence
  Description of Artificial Sequence: Synthetic oligonucleotide
  Description of Combined DNA/RNA Molecule: Synthetic oligonucleotide
aaaauauauugugcaauuguggcuacc

SEQ ID NO: 297 - RNA, 27 nt, Artificial Sequence
  Description of Artificial Sequence: Synthetic oligonucleotide
  Description of Combined DNA/RNA Molecule: Synthetic oligonucleotide
agaaaauauauugugcaauuguggcua

SEQ ID NO: 298 - RNA, 27 nt, Artificial Sequence
  Description of Artificial Sequence: Synthetic oligonucleotide
  Description of Combined DNA/RNA Molecule: Synthetic oligonucleotide
uaagaaaauauauugugcaauuguggc

SEQ ID NO: 299 - RNA, 27 nt, Artificial Sequence
  Description of Artificial Sequence: Synthetic oligonucleotide
  Description of Combined DNA/RNA Molecule: Synthetic oligonucleotide
uuuaagaaaauauauugugcaauugug

SEQ ID NO: 300 - RNA, 27 nt, Artificial Sequence
  Description of Artificial Sequence: Synthetic oligonucleotide
  Description of Combined DNA/RNA Molecule: Synthetic oligonucleotide
uuuuuaagaaaauauauugugcaauug

SEQ ID NO: 301 - RNA, 27 nt, Artificial Sequence
  Description of Artificial Sequence: Synthetic oligonucleotide
  Description of Combined DNA/RNA Molecule: Synthetic oligonucleotide
ugguauuuuuuaagaaaauauauugug

SEQ ID NO: 302 - RNA, 27 nt, Artificial Sequence
  Description of Artificial Sequence: Synthetic oligonucleotide
  Description of Combined DNA/RNA Molecule: Synthetic oligonucleotide
cuucuuaaaaacuaguuuuauaaacgc

SEQ ID NO: 303 - RNA, 27 nt, Artificial Sequence
  Description of Artificial Sequence: Synthetic oligonucleotide
  Description of Combined DNA/RNA Molecule: Synthetic oligonucleotide
ucuucuuaaaaacuaguuuuauaaacg

SEQ ID NO: 304 - RNA, 27 nt, Artificial Sequence
  Description of Artificial Sequence: Synthetic oligonucleotide
  Description of Combined DNA/RNA Molecule: Synthetic oligonucleotide
uuucuucuuaaaaacuaguuuuauaaa

SEQ ID NO: 305 - RNA, 27 nt, Artificial Sequence
  Description of Artificial Sequence: Synthetic oligonucleotide
  Description of Combined DNA/RNA Molecule: Synthetic oligonucleotide
aauuucuucuuaaaaacuaguuuuaua

SEQ ID NO: 306 - RNA, 27 nt, Artificial Sequence
  Description of Artificial Sequence: Synthetic oligonucleotide
  Description of Combined DNA/RNA Molecule: Synthetic oligonucleotide
uaggccaaaaaaaauuucuucuuaaaa

SEQ ID NO: 307 - RNA, 27 nt, Artificial Sequence
  Description of Artificial Sequence: Synthetic oligonucleotide
  Description of Combined DNA/RNA Molecule: Synthetic oligonucleotide
auuucauaggccaaaaaaaauuucuuc

SEQ ID NO: 308 - RNA, 27 nt, Artificial Sequence
  Description of Artificial Sequence: Synthetic oligonucleotide
  Description of Combined DNA/RNA Molecule: Synthetic oligonucleotide
caauuucauaggccaaaaaaaauuucu

SEQ ID NO: 309 - RNA, 27 nt, Artificial Sequence
  Description of Artificial Sequence: Synthetic oligonucleotide
  Description of Combined DNA/RNA Molecule: Synthetic oligonucleotide
auguuccagguuuaacaauuucauagg

SEQ ID NO: 310 - RNA, 27 nt, Artificial Sequence
  Description of Artificial Sequence: Synthetic oligonucleotide
  Description of Combined DNA/RNA Molecule: Synthetic oligonucleotide
gaaucauuauuauaugauuaacaaugu

SEQ ID NO: 311 - RNA, 27 nt, Artificial Sequence
  Description of Artificial Sequence: Synthetic oligonucleotide
  Description of Combined DNA/RNA Molecule: Synthetic oligonucleotide
uuuacccauuuaaauaauaaaccauac

SEQ ID NO: 312 - RNA, 27 nt, Artificial Sequence
  Description of Artificial Sequence: Synthetic oligonucleotide
  Description of Combined DNA/RNA Molecule: Synthetic oligonucleotide
uauauuauguaaauggcuuuacccauu

SEQ ID NO: 313 - RNA, 27 nt, Artificial Sequence
  Description of Artificial Sequence: Synthetic oligonucleotide
  Description of Combined DNA/RNA Molecule: Synthetic oligonucleotide
gcauaucuuucuauauuauguaaaugg

SEQ ID NO: 314 - RNA, 27 nt, Artificial Sequence
  Description of Artificial Sequence: Synthetic oligonucleotide
  Description of Combined DNA/RNA Molecule: Synthetic oligonucleotide
uauccaaauaaaugccacauaccuucu

SEQ ID NO: 315 - RNA, 27 nt, Artificial Sequence
  Description of Artificial Sequence: Synthetic oligonucleotide
  Description of Combined DNA/RNA Molecule: Synthetic oligonucleotide
uuuauccaaauaaaugccacauaccuu

SEQ ID NO: 316 - RNA, 27 nt, Artificial Sequence
  Description of Artificial Sequence: Synthetic oligonucleotide
  Description of Combined DNA/RNA Molecule: Synthetic oligonucleotide
auuuuauccaaauaaaugccacauacc

SEQ ID NO: 317 - RNA, 27 nt, Artificial Sequence
  Description of Artificial Sequence: Synthetic oligonucleotide
  Description of Combined DNA/RNA Molecule: Synthetic oligonucleotide
gaauuuuauccaaauaaaugccacaua

SEQ ID NO: 318 - RNA, 27 nt, Artificial Sequence
  Description of Artificial Sequence: Synthetic oligonucleotide
  Description of Combined DNA/RNA Molecule: Synthetic oligonucleotide
gagaauuuuauccaaauaaaugccaca

SEQ ID NO: 319 - RNA, 27 nt, Artificial Sequence
  Description of Artificial Sequence: Synthetic oligonucleotide
  Description of Combined DNA/RNA Molecule: Synthetic oligonucleotide
uugagaauuuuauccaaauaaaugcca

SEQ ID NO: 320 - RNA, 27 nt, Artificial Sequence
  Description of Artificial Sequence: Synthetic oligonucleotide
  Description of Combined DNA/RNA Molecule: Synthetic oligonucleotide
aauugagaauuuuauccaaauaaaugc

SEQ ID NO: 321 - RNA, 27 nt, Artificial Sequence
  Description of Artificial Sequence: Synthetic oligonucleotide
  Description of Combined DNA/RNA Molecule: Synthetic oligonucleotide
ugaauugagaauuuuauccaaauaaau

SEQ ID NO: 322 - RNA, 27 nt, Artificial Sequence
  Description of Artificial Sequence: Synthetic oligonucleotide
  Description of Combined DNA/RNA Molecule: Synthetic oligonucleotide
ucugaauugagaauuuuauccaaauaa

SEQ ID NO: 323 - RNA, 27 nt, Artificial Sequence
  Description of Artificial Sequence: Synthetic oligonucleotide
  Description of Combined DNA/RNA Molecule: Synthetic oligonucleotide
ucugaauugagaauuuuauccaaauaa

SEQ ID NO: 324 - RNA, 27 nt, Artificial Sequence
  Description of Artificial Sequence: Synthetic oligonucleotide
  Description of Combined DNA/RNA Molecule: Synthetic oligonucleotide
ucucugaauugagaauuuuauccaaau

SEQ ID NO: 325 - RNA, 27 nt, Artificial Sequence
  Description of Artificial Sequence: Synthetic oligonucleotide
  Description of Combined DNA/RNA Molecule: Synthetic oligonucleotide
uuucucugaauugagaauuuuauccaa

SEQ ID NO: 326 - RNA, 27 nt, Artificial Sequence
  Description of Artificial Sequence: Synthetic oligonucleotide
  Description of Combined DNA/RNA Molecule: Synthetic oligonucleotide
gauuucucugaauugagaauuuuaucc

SEQ ID NO: 327 - RNA, 27 nt, Artificial Sequence
  Description of Artificial Sequence: Synthetic oligonucleotide
  Description of Combined DNA/RNA Molecule: Synthetic oligonucleotide
augauuucucugaauugagaauuuuau

SEQ ID NO: 328 - RNA, 27 nt, Artificial Sequence
  Description of Artificial Sequence: Synthetic oligonucleotide
  Description of Combined DNA/RNA Molecule: Synthetic oligonucleotide
gcaaagugacuauagaaacaucagaug

SEQ ID NO: 329 - RNA, 27 nt, Artificial Sequence
  Description of Artificial Sequence: Synthetic oligonucleotide
  Description of Combined DNA/RNA Molecule: Synthetic oligonucleotide
gagcuggcaaagugacuauagaaacau

SEQ ID NO: 330 - RNA, 27 nt, Artificial Sequence
  Description of Artificial Sequence: Synthetic oligonucleotide
  Description of Combined DNA/RNA Molecule: Synthetic oligonucleotide
cuuuugagcuggcaaagugacuauaga

SEQ ID NO: 331 - RNA, 27 nt, Artificial Sequence
  Description of Artificial Sequence: Synthetic oligonucleotide
  Description of Combined DNA/RNA Molecule: Synthetic oligonucleotide
cuacauaggguauuguuuucuuuugag

SEQ ID NO: 332 - RNA, 27 nt, Artificial Sequence
  Description of Artificial Sequence: Synthetic oligonucleotide
  Description of Combined DNA/RNA Molecule: Synthetic oligonucleotide
cuuuauaccaacaggguaggcagaaca

SEQ ID NO: 333 - RNA, 27 nt, Artificial Sequence
  Description of Artificial Sequence: Synthetic oligonucleotide
  Description of Combined DNA/RNA Molecule: Synthetic oligonucleotide
aucuuuauaccaacaggguaggcagaa

SEQ ID NO: 334 - RNA, 27 nt, Artificial Sequence
  Description of Artificial Sequence: Synthetic oligonucleotide
  Description of Combined DNA/RNA Molecule: Synthetic oligonucleotide
uaucuuuauaccaacaggguaggcaga

SEQ ID NO: 335 - RNA, 27 nt, Artificial Sequence
  Description of Artificial Sequence: Synthetic oligonucleotide
  Description of Combined DNA/RNA Molecule: Synthetic oligonucleotide
aauaucuuuauaccaacaggguaggca

SEQ ID NO: 336 - RNA, 27 nt, Artificial Sequence
  Description of Artificial Sequence: Synthetic oligonucleotide
  Description of Combined DNA/RNA Molecule: Synthetic oligonucleotide
aaauaucuuuauaccaacaggguaggc

SEQ ID NO: 337 - RNA, 27 nt, Artificial Sequence
  Description of Artificial Sequence: Synthetic oligonucleotide
  Description of Combined DNA/RNA Molecule: Synthetic oligonucleotide
gcucaaaauaucuuuauaccaacaggg

SEQ ID NO: 338 - RNA, 27 nt, Artificial Sequence
  Description of Artificial Sequence: Synthetic oligonucleotide
  Description of Combined DNA/RNA Molecule: Synthetic oligonucleotide
ucugcucaaaauaucuuuauaccaaca

SEQ ID NO: 339 - RNA, 27 nt, Artificial Sequence
  Description of Artificial Sequence: Synthetic oligonucleotide
  Description of Combined DNA/RNA Molecule: Synthetic oligonucleotide
uaagaaugcaugauuuuuuuuuucuug

SEQ ID NO: 340 - RNA, 27 nt, Artificial Sequence
  Description of Artificial Sequence: Synthetic oligonucleotide
  Description of Combined DNA/RNA Molecule: Synthetic oligonucleotide
auuguauuuugagcaaauuaacauacu

SEQ ID NO: 341 - RNA, 27 nt, Artificial Sequence
  Description of Artificial Sequence: Synthetic oligonucleotide
  Description of Combined DNA/RNA Molecule: Synthetic oligonucleotide
guuaauagcgacaaagugcauaaaauc

SEQ ID NO: 342 - RNA, 27 nt, Artificial Sequence
  Description of Artificial Sequence: Synthetic oligonucleotide
  Description of Combined DNA/RNA Molecule: Synthetic oligonucleotide
auguuaauagcgacaaagugcauaaaa

SEQ ID NO: 343 - RNA, 27 nt, Artificial Sequence
  Description of Artificial Sequence: Synthetic oligonucleotide
  Description of Combined DNA/RNA Molecule: Synthetic oligonucleotide
ggauguuaauagcgacaaagugcauaa

SEQ ID NO: 344 - RNA, 27 nt, Artificial Sequence
  Description of Artificial Sequence: Synthetic oligonucleotide
  Description of Combined DNA/RNA Molecule: Synthetic oligonucleotide
aaggauguuaauagcgacaaagugcau

SEQ ID NO: 345 - RNA, 27 nt, Artificial Sequence
  Description of Artificial Sequence: Synthetic oligonucleotide
  Description of Combined DNA/RNA Molecule: Synthetic oligonucleotide
aaaaggauguuaauagcgacaaagugc

SEQ ID NO: 346 - RNA, 27 nt, Artificial Sequence
  Description of Artificial Sequence: Synthetic oligonucleotide
  Description of Combined DNA/RNA Molecule: Synthetic oligonucleotide
aaaaaaggauguuaauagcgacaaagu

SEQ ID NO: 347 - RNA, 27 nt, Artificial Sequence
  Description of Artificial Sequence: Synthetic oligonucleotide
  Description of Combined DNA/RNA Molecule: Synthetic oligonucleotide
gaaaaaaaggauguuaauagcgacaaa

SEQ ID NO: 348 - RNA, 27 nt, Artificial Sequence
  Description of Artificial Sequence: Synthetic oligonucleotide
  Description of Combined DNA/RNA Molecule: Synthetic oligonucleotide
augaaaaaaaggauguuaauagcgaca

SEQ ID NO: 349 - RNA, 27 nt, Artificial Sequence
  Description of Artificial Sequence: Synthetic oligonucleotide
  Description of Combined DNA/RNA Molecule: Synthetic oligonucleotide
acaugaaaaaaaggauguuaauagcga

SEQ ID NO: 350 - RNA, 27 nt, Artificial Sequence
  Description of Artificial Sequence: Synthetic oligonucleotide
  Description of Combined DNA/RNA Molecule: Synthetic oligonucleotide
ucuacaugaaaaaaaggauguuaauag

SEQ ID NO: 351 - RNA, 27 nt, Artificial Sequence
  Description of Artificial Sequence: Synthetic oligonucleotide
  Description of Combined DNA/RNA Molecule: Synthetic oligonucleotide
uaaaauaaugcuucuaaaauuacucaa

SEQ ID NO: 352 - RNA, 27 nt, Artificial Sequence
  Description of Artificial Sequence: Synthetic oligonucleotide
  Description of Combined DNA/RNA Molecule: Synthetic oligonucleotide
ccuaaaauaaugcuucuaaaauuacuc

SEQ ID NO: 353 - RNA, 27 nt, Artificial Sequence
  Description of Artificial Sequence: Synthetic oligonucleotide
  Description of Combined DNA/RNA Molecule: Synthetic oligonucleotide
uuccuaaaauaaugcuucuaaaauuac

SEQ ID NO: 354 - RNA, 27 nt, Artificial Sequence
  Description of Artificial Sequence: Synthetic oligonucleotide
  Description of Combined DNA/RNA Molecule: Synthetic oligonucleotide
uauuccuaaaauaaugcuucuaaaauu

SEQ ID NO: 355 - RNA, 27 nt, Artificial Sequence
  Description of Artificial Sequence: Synthetic oligonucleotide
  Description of Combined DNA/RNA Molecule: Synthetic oligonucleotide
uauauuccuaaaauaaugcuucuaaaa

SEQ ID NO: 356 - RNA, 27 nt, Artificial Sequence
  Description of Artificial Sequence: Synthetic oligonucleotide
  Description of Combined DNA/RNA Molecule: Synthetic oligonucleotide
uauauauuccuaaaauaaugcuucuaa

SEQ ID NO: 357 - RNA, 27 nt, Artificial Sequence
  Description of Artificial Sequence: Synthetic oligonucleotide
  Description of Combined DNA/RNA Molecule: Synthetic oligonucleotide
acuauauauuccuaaaauaaugcuucu

SEQ ID NO: 358 - RNA, 27 nt, Artificial Sequence
  Description of Artificial Sequence: Synthetic oligonucleotide
  Description of Combined DNA/RNA Molecule: Synthetic oligonucleotide
caacuauauauuccuaaaauaaugcuu

SEQ ID NO: 359 - RNA, 27 nt, Artificial Sequence
  Description of Artificial Sequence: Synthetic oligonucleotide
  Description of Combined DNA/RNA Molecule: Synthetic oligonucleotide
guacauagaaaaaacaagauauuuacu

SEQ ID NO: 360 - RNA, 27 nt, Artificial Sequence
  Description of Artificial Sequence: Synthetic oligonucleotide
  Description of Combined DNA/RNA Molecule: Synthetic oligonucleotide
aaugaaaaauuuguacaauguacauag

SEQ ID NO: 361 - RNA, 27 nt, Artificial Sequence
  Description of Artificial Sequence: Synthetic oligonucleotide
  Description of Combined DNA/RNA Molecule: Synthetic oligonucleotide
aaccacaaagagcaaaaggaaugaaaa

SEQ ID NO: 362 - RNA, 27 nt, Artificial Sequence
  Description of Artificial Sequence: Synthetic oligonucleotide
  Description of Combined DNA/RNA Molecule: Synthetic oligonucleotide
caaccacaaagagcaaaaggaaugaaa

SEQ ID NO: 363 - RNA, 27 nt, Artificial Sequence
  Description of Artificial Sequence: Synthetic oligonucleotide
  Description of Combined DNA/RNA Molecule: Synthetic oligonucleotide
ccaaccacaaagagcaaaaggaaugaa

SEQ ID NO: 364 - RNA, 27 nt, Artificial Sequence
  Description of Artificial Sequence: Synthetic oligonucleotide
  Description of Combined DNA/RNA Molecule: Synthetic oligonucleotide
auccaaccacaaagagcaaaaggaaug

SEQ ID NO: 365 - RNA, 27 nt, Artificial Sequence
  Description of Artificial Sequence: Synthetic oligonucleotide
  Description of Combined DNA/RNA Molecule: Synthetic oligonucleotide
gauccaaccacaaagagcaaaaggaau

SEQ ID NO: 366 - RNA, 27 nt, Artificial Sequence
  Description of Artificial Sequence: Synthetic oligonucleotide
  Description of Combined DNA/RNA Molecule: Synthetic oligonucleotide
agauccaaccacaaagagcaaaaggaa

SEQ ID NO: 367 - RNA, 27 nt, Artificial Sequence
  Description of Artificial Sequence: Synthetic oligonucleotide
  Description of Combined DNA/RNA Molecule: Synthetic oligonucleotide
uagauccaaccacaaagagcaaaagga

SEQ ID NO: 368 - RNA, 27 nt, Artificial Sequence
  Description of Artificial Sequence: Synthetic oligonucleotide
  Description of Combined DNA/RNA Molecule: Synthetic oligonucleotide
uuagauccaaccacaaagagcaaaagg

SEQ ID NO: 369 - RNA, 27 nt, Artificial Sequence
  Description of Artificial Sequence: Synthetic oligonucleotide
  Description of Combined DNA/RNA Molecule: Synthetic oligonucleotide
guuagauccaaccacaaagagcaaaag

SEQ ID NO: 370 - RNA, 27 nt, Artificial Sequence
  Description of Artificial Sequence: Synthetic oligonucleotide
  Description of Combined DNA/RNA Molecule: Synthetic oligonucleotide
uguuagauccaaccacaaagagcaaaa

SEQ ID NO: 371 - RNA, 27 nt, Artificial Sequence
  Description of Artificial Sequence: Synthetic oligonucleotide
  Description of Combined DNA/RNA Molecule: Synthetic oligonucleotide
guguuagauccaaccacaaagagcaaa

SEQ ID NO: 372 - RNA, 27 nt, Artificial Sequence
  Description of Artificial Sequence: Synthetic oligonucleotide
  Description of Combined DNA/RNA Molecule: Synthetic oligonucleotide
uaguguuagauccaaccacaaagagca

SEQ ID NO: 373 - RNA, 27 nt, Artificial Sequence
  Description of Artificial Sequence: Synthetic oligonucleotide
  Description of Combined DNA/RNA Molecule: Synthetic oligonucleotide
gguccacagaagauguuuauuugaugu

SEQ ID NO: 374 - RNA, 27 nt, Artificial Sequence
  Description of Artificial Sequence: Synthetic oligonucleotide
  Description of Combined DNA/RNA Molecule: Synthetic oligonucleotide
cugguccacagaagauguuuauuugau

SEQ ID NO: 375 - RNA, 27 nt, Artificial Sequence
  Description of Artificial Sequence: Synthetic oligonucleotide
  Description of Combined DNA/RNA Molecule: Synthetic oligonucleotide
gccugguccacagaagauguuuauuug

SEQ ID NO: 376 - RNA, 27 nt, Artificial Sequence
  Description of Artificial Sequence: Synthetic oligonucleotide
  Description of Combined DNA/RNA Molecule: Synthetic oligonucleotide
uugccugguccacagaagauguuuauu

SEQ ID NO: 377 - RNA, 27 nt, Artificial Sequence
  Description of Artificial Sequence: Synthetic oligonucleotide
  Description of Combined DNA/RNA Molecule: Synthetic oligonucleotide
uuuugccugguccacagaagauguuua

SEQ ID NO: 378 - RNA, 27 nt, Artificial Sequence
  Description of Artificial Sequence: Synthetic oligonucleotide
  Description of Combined DNA/RNA Molecule: Synthetic oligonucleotide
uuuuuugccugguccacagaagauguu

SEQ ID NO: 379 - DNA, 25 bp, Artificial Sequence
  Description of Artificial Sequence: Synthetic oligonucleotide
  Description of Combined DNA/RNA Molecule: Synthetic oligonucleotide
gcgcgcccgagcgcgccuccgccct

SEQ ID NO: 380 - DNA, 25 bp, Artificial Sequence
  Description of Artificial Sequence: Synthetic oligonucleotide
  Description of Combined DNA/RNA Molecule: Synthetic oligonucleotide
gcgcccgagcgcgccuccgcccutg

SEQ ID NO: 381 - DNA, 25 bp, Artificial Sequence
  Description of Artificial Sequence: Synthetic oligonucleotide
  Description of Combined DNA/RNA Molecule: Synthetic oligonucleotide
gcccgagcgcgccuccgcccuugcc

SEQ ID NO: 382 - DNA, 25 bp, Artificial Sequence
  Description of Artificial Sequence: Synthetic oligonucleotide
  Description of Combined DNA/RNA Molecule: Synthetic oligonucleotide
ccgagcgcgccuccgcccuugcccg

SEQ ID NO: 383 - DNA, 25 bp, Artificial Sequence
  Description of Artificial Sequence: Synthetic oligonucleotide
  Description of Combined DNA/RNA Molecule: Synthetic oligonucleotide
gagcgcgccuccgcccuugcccgcc

SEQ ID NO: 384 - DNA, 25 bp, Artificial Sequence
  Description of Artificial Sequence: Synthetic oligonucleotide
  Description of Combined DNA/RNA Molecule: Synthetic oligonucleotide
ugccucagcuccucagugcacagtg

SEQ ID NO: 385 - DNA, 25 bp, Artificial Sequence
  Description of Artificial Sequence: Synthetic oligonucleotide
  Description of Combined DNA/RNA Molecule: Synthetic oligonucleotide
gccucagcuccucagugcacagugc

SEQ ID NO: 386 - DNA, 25 bp, Artificial Sequence
  Description of Artificial Sequence: Synthetic oligonucleotide
  Description of Combined DNA/RNA Molecule: Synthetic oligonucleotide
cucagcuccucagugcacagugctg

SEQ ID NO: 387 - DNA, 25 bp, Artificial Sequence
  Description of Artificial Sequence: Synthetic oligonucleotide
  Description of Combined DNA/RNA Molecule: Synthetic oligonucleotide
gcuccucagugcacagugcugcctc

SEQ ID NO: 388 - DNA, 25 bp, Artificial Sequence
  Description of Artificial Sequence: Synthetic oligonucleotide
  Description of Combined DNA/RNA Molecule: Synthetic oligonucleotide
cuccucagugcacagugcugccucg

SEQ ID NO: 389 - DNA, 25 bp, Artificial Sequence
  Description of Artificial Sequence: Synthetic oligonucleotide
  Description of Combined DNA/RNA Molecule: Synthetic oligonucleotide
gcugccucgucugaggggacaggag

SEQ ID NO: 390 - DNA, 25 bp, Artificial Sequence
  Description of Artificial Sequence: Synthetic oligonucleotide
  Description of Combined DNA/RNA Molecule: Synthetic oligonucleotide
uugccgcccgcuucucucuaguctc

SEQ ID NO: 391 - DNA, 25 bp, Artificial Sequence
  Description of Artificial Sequence: Synthetic oligonucleotide
  Description of Combined DNA/RNA Molecule: Synthetic oligonucleotide
gccgcccgcuucucucuagucucac

SEQ ID NO: 392 - DNA, 25 bp, Artificial Sequence
  Description of Artificial Sequence: Synthetic oligonucleotide
  Description of Combined DNA/RNA Molecule: Synthetic oligonucleotide
ccgcccgcuucucucuagucucacg

SEQ ID NO: 393 - DNA, 25 bp, Artificial Sequence
  Description of Artificial Sequence: Synthetic oligonucleotide
  Description of Combined DNA/RNA Molecule: Synthetic oligonucleotide
gagggguuucccgccucgcaccccc

SEQ ID NO: 394 - DNA, 25 bp, Artificial Sequence
  Description of Artificial Sequence: Synthetic oligonucleotide
  Description of Combined DNA/RNA Molecule: Synthetic oligonucleotide
cucuggacuugccuuuccuucuctt

SEQ ID NO: 395 - DNA, 25 bp, Artificial Sequence
  Description of Artificial Sequence: Synthetic oligonucleotide
  Description of Combined DNA/RNA Molecule: Synthetic oligonucleotide
uggacuugccuuuccuucucuuctc

SEQ ID NO: 396 - DNA, 25 bp, Artificial Sequence
  Description of Artificial Sequence: Synthetic oligonucleotide
  Description of Combined DNA/RNA Molecule: Synthetic oligonucleotide
gacuugccuuuccuucucuucuccg

SEQ ID NO: 397 - DNA, 25 bp, Artificial Sequence
  Description of Artificial Sequence: Synthetic oligonucleotide
  Description of Combined DNA/RNA Molecule: Synthetic oligonucleotide
uugccuuuccuucucuucuccgcgt

SEQ ID NO: 398 - DNA, 25 bp, Artificial Sequence
  Description of Artificial Sequence: Synthetic oligonucleotide
  Description of Combined DNA/RNA Molecule: Synthetic oligonucleotide
gccuuuccuucucuucuccgcgugt

SEQ ID NO: 399 - DNA, 25 bp, Artificial Sequence
  Description of Artificial Sequence: Synthetic oligonucleotide
  Description of Combined DNA/RNA Molecule: Synthetic oligonucleotide
ccuuuccuucucuucuccgcgugtg

SEQ ID NO: 400 - DNA, 25 bp, Artificial Sequence
  Description of Artificial Sequence: Synthetic oligonucleotide
  Description of Combined DNA/RNA Molecule: Synthetic oligonucleotide
cuuuccuucucuucuccgcgugugg

SEQ ID NO: 401 - DNA, 25 bp, Artificial Sequence
  Description of Artificial Sequence: Synthetic oligonucleotide
  Description of Combined DNA/RNA Molecule: Synthetic oligonucleotide
uucuccgcguguggagggagccagc

SEQ ID NO: 402 - DNA, 25 bp, Artificial Sequence
  Description of Artificial Sequence: Synthetic oligonucleotide
  Description of Combined DNA/RNA Molecule: Synthetic oligonucleotide
cuccgcguguggagggagccagcgc

SEQ ID NO: 403 - DNA, 25 bp, Artificial Sequence
  Description of Artificial Sequence: Synthetic oligonucleotide
  Description of Combined DNA/RNA Molecule: Synthetic oligonucleotide
ccgcguguggagggagccagcgctt

SEQ ID NO: 404 - DNA, 25 bp, Artificial Sequence
  Description of Artificial Sequence: Synthetic oligonucleotide
  Description of Combined DNA/RNA Molecule: Synthetic oligonucleotide
gagccagcgcuuaggccggagcgag

SEQ ID NO: 405 - DNA, 25 bp, Artificial Sequence
  Description of Artificial Sequence: Synthetic oligonucleotide
  Description of Combined DNA/RNA Molecule: Synthetic oligonucleotide
gaagacaucgcggggaccgauucac

SEQ ID NO: 406 - DNA, 25 bp, Artificial Sequence
  Description of Artificial Sequence: Synthetic oligonucleotide
  Description of Combined DNA/RNA Molecule: Synthetic oligonucleotide
auucaccauggagggcgccggcggc

SEQ ID NO: 407 - DNA, 25 bp, Artificial Sequence
  Description of Artificial Sequence: Synthetic oligonucleotide
  Description of Combined DNA/RNA Molecule: Synthetic oligonucleotide
ccauggagggcgccggcggcgcgaa

SEQ ID NO: 408 - DNA, 25 bp, Artificial Sequence
  Description of Artificial Sequence: Synthetic oligonucleotide
  Description of Combined DNA/RNA Molecule: Synthetic oligonucleotide
auggagggcgccggcggcgcgaacg

SEQ ID NO: 409 - DNA, 25 bp, Artificial Sequence
  Description of Artificial Sequence: Synthetic oligonucleotide
  Description of Combined DNA/RNA Molecule: Synthetic oligonucleotide
cgaacgacaagaaaaagauaagutc

SEQ ID NO: 410 - DNA, 25 bp, Artificial Sequence
  Description of Artificial Sequence: Synthetic oligonucleotide
  Description of Combined DNA/RNA Molecule: Synthetic oligonucleotide
caagaaaaagauaaguucugaacgt

SEQ ID NO: 411 - DNA, 25 bp, Artificial Sequence
  Description of Artificial Sequence: Synthetic oligonucleotide
  Description of Combined DNA/RNA Molecule: Synthetic oligonucleotide
guucugaacgucgaaaagaaaagtc

SEQ ID NO: 412 - DNA, 25 bp, Artificial Sequence
  Description of Artificial Sequence: Synthetic oligonucleotide
  Description of Combined DNA/RNA Molecule: Synthetic oligonucleotide
ucugaacgucgaaaagaaaaguctc

SEQ ID NO: 413 - DNA, 25 bp, Artificial Sequence
  Description of Artificial Sequence: Synthetic oligonucleotide
  Description of Combined DNA/RNA Molecule: Synthetic oligonucleotide
ugaacgucgaaaagaaaagucucga

SEQ ID NO: 414 - DNA, 25 bp, Artificial Sequence
  Description of Artificial Sequence: Synthetic oligonucleotide
  Description of Combined DNA/RNA Molecule: Synthetic oligonucleotide
aacgucgaaaagaaaagucucgaga

SEQ ID NO: 415 - DNA, 25 bp, Artificial Sequence
  Description of Artificial Sequence: Synthetic oligonucleotide
  Description of Combined DNA/RNA Molecule: Synthetic oligonucleotide
gaaucugaaguuuuuuaugagcutg

SEQ ID NO: 416 - DNA, 25 bp, Artificial Sequence
  Description of Artificial Sequence: Synthetic oligonucleotide
  Description of Combined DNA/RNA Molecule: Synthetic oligonucleotide
ucugaaguuuuuuaugagcuugctc

SEQ ID NO: 417 - DNA, 25 bp, Artificial Sequence
  Description of Artificial Sequence: Synthetic oligonucleotide
  Description of Combined DNA/RNA Molecule: Synthetic oligonucleotide
ugaaguuuuuuaugagcuugcucat

SEQ ID NO: 418 - DNA, 25 bp, Artificial Sequence
  Description of Artificial Sequence: Synthetic oligonucleotide
  Description of Combined DNA/RNA Molecule: Synthetic oligonucleotide
aaguuuuuuaugagcuugcucauca

SEQ ID NO: 419 - DNA, 25 bp, Artificial Sequence
  Description of Artificial Sequence: Synthetic oligonucleotide
  Description of Combined DNA/RNA Molecule: Synthetic oligonucleotide
guuuuuuaugagcuugcucaucagt

SEQ ID NO: 420 - DNA, 25 bp, Artificial Sequence
  Description of Artificial Sequence: Synthetic oligonucleotide
  Description of Combined DNA/RNA Molecule: Synthetic oligonucleotide
uuuuuaugagcuugcucaucagutg

SEQ ID NO: 421 - DNA, 25 bp, Artificial Sequence
  Description of Artificial Sequence: Synthetic oligonucleotide
  Description of Combined DNA/RNA Molecule: Synthetic oligonucleotide
uuuaugagcuugcucaucaguugcc

SEQ ID NO: 422 - DNA, 25 bp, Artificial Sequence
  Description of Artificial Sequence: Synthetic oligonucleotide
  Description of Combined DNA/RNA Molecule: Synthetic oligonucleotide
uaugagcuugcucaucaguugccac

SEQ ID NO: 423 - DNA, 25 bp, Artificial Sequence
  Description of Artificial Sequence: Synthetic oligonucleotide
  Description of Combined DNA/RNA Molecule: Synthetic oligonucleotide
ugagcuugcucaucaguugccactt

SEQ ID NO: 424 - DNA, 25 bp, Artificial Sequence
  Description of Artificial Sequence: Synthetic oligonucleotide
  Description of Combined DNA/RNA Molecule: Synthetic oligonucleotide
agcuugcucaucaguugccacuucc

SEQ ID NO: 425 - DNA, 25 bp, Artificial Sequence
  Description of Artificial Sequence: Synthetic oligonucleotide
  Description of Combined DNA/RNA Molecule: Synthetic oligonucleotide
cuugcucaucaguugccacuuccac

SEQ ID NO: 426 - DNA, 25 bp, Artificial Sequence
  Description of Artificial Sequence: Synthetic oligonucleotide
  Description of Combined DNA/RNA Molecule: Synthetic oligonucleotide
ugcucaucaguugccacuuccacat

SEQ ID NO: 427 - DNA, 25 bp, Artificial Sequence
  Description of Artificial Sequence: Synthetic oligonucleotide
  Description of Combined DNA/RNA Molecule: Synthetic oligonucleotide
cucaucaguugccacuuccacauaa

SEQ ID NO: 428 - DNA, 25 bp, Artificial Sequence
  Description of Artificial Sequence: Synthetic oligonucleotide
  Description of Combined DNA/RNA Molecule: Synthetic oligonucleotide
cacuuccacauaaugugaguucgca

SEQ ID NO: 429 - DNA, 25 bp, Artificial Sequence
  Description of Artificial Sequence: Synthetic oligonucleotide
  Description of Combined DNA/RNA Molecule: Synthetic oligonucleotide
cuucuggaugcuggugauuuggata

SEQ ID NO: 430 - DNA, 25 bp, Artificial Sequence
  Description of Artificial Sequence: Synthetic oligonucleotide
  Description of Combined DNA/RNA Molecule: Synthetic oligonucleotide
ucuggaugcuggugauuuggauatt

SEQ ID NO: 431 - DNA, 25 bp, Artificial Sequence
  Description of Artificial Sequence: Synthetic oligonucleotide
  Description of Combined DNA/RNA Molecule: Synthetic oligonucleotide
cuggaugcuggugauuuggauautg

SEQ ID NO: 432 - DNA, 25 bp, Artificial Sequence
  Description of Artificial Sequence: Synthetic oligonucleotide
  Description of Combined DNA/RNA Molecule: Synthetic oligonucleotide
uauugaagaugacaugaaagcacag

SEQ ID NO: 433 - DNA, 25 bp, Artificial Sequence
  Description of Artificial Sequence: Synthetic oligonucleotide
  Description of Combined DNA/RNA Molecule: Synthetic oligonucleotide
ugaauugcuuuuauuugaaagcctt

SEQ ID NO: 434 - DNA, 25 bp, Artificial Sequence
  Description of Artificial Sequence: Synthetic oligonucleotide
  Description of Combined DNA/RNA Molecule: Synthetic oligonucleotide
gaaagccuuggaugguuuuguuatg

SEQ ID NO: 435 - DNA, 25 bp, Artificial Sequence
  Description of Artificial Sequence: Synthetic oligonucleotide
  Description of Combined DNA/RNA Molecule: Synthetic oligonucleotide
gccuuggaugguuuuguuauggutc

SEQ ID NO: 436 - DNA, 25 bp, Artificial Sequence
  Description of Artificial Sequence: Synthetic oligonucleotide
  Description of Combined DNA/RNA Molecule: Synthetic oligonucleotide
cuuggaugguuuuguuaugguuctc

SEQ ID NO: 437 - DNA, 25 bp, Artificial Sequence
  Description of Artificial Sequence: Synthetic oligonucleotide
  Description of Combined DNA/RNA Molecule: Synthetic oligonucleotide
uggaugguuuuguuaugguucucac

SEQ ID NO: 438 - DNA, 25 bp, Artificial Sequence
  Description of Artificial Sequence: Synthetic oligonucleotide
  Description of Combined DNA/RNA Molecule: Synthetic oligonucleotide
gaugguuuuguuaugguucucacag

SEQ ID NO: 439 - DNA, 25 bp, Artificial Sequence
  Description of Artificial Sequence: Synthetic oligonucleotide
  Description of Combined DNA/RNA Molecule: Synthetic oligonucleotide
auuuacauuucugauaaugugaaca

SEQ ID NO: 440 - DNA, 25 bp, Artificial Sequence
  Description of Artificial Sequence: Synthetic oligonucleotide
  Description of Combined DNA/RNA Molecule: Synthetic oligonucleotide
gauuaacucaguuugaacuaacugg

SEQ ID NO: 441 - DNA, 25 bp, Artificial Sequence
  Description of Artificial Sequence: Synthetic oligonucleotide
  Description of Combined DNA/RNA Molecule: Synthetic oligonucleotide
uaacucaguuugaacuaacuggaca

SEQ ID NO: 442 - DNA, 25 bp, Artificial Sequence
  Description of Artificial Sequence: Synthetic oligonucleotide
  Description of Combined DNA/RNA Molecule: Synthetic oligonucleotide
guuugauuuuacucauccaugugac

SEQ ID NO: 443 - DNA, 25 bp, Artificial Sequence
  Description of Artificial Sequence: Synthetic oligonucleotide
  Description of Combined DNA/RNA Molecule: Synthetic oligonucleotide
uugauuuuacucauccaugugacca

SEQ ID NO: 444 - DNA, 25 bp, Artificial Sequence
  Description of Artificial Sequence: Synthetic oligonucleotide
  Description of Combined DNA/RNA Molecule: Synthetic oligonucleotide
gauuuuacucauccaugugaccatg

SEQ ID NO: 445 - DNA, 25 bp, Artificial Sequence
  Description of Artificial Sequence: Synthetic oligonucleotide
  Description of Combined DNA/RNA Molecule: Synthetic oligonucleotide
uuuuacucauccaugugaccaugag

SEQ ID NO: 446 - DNA, 25 bp, Artificial Sequence
  Description of Artificial Sequence: Synthetic oligonucleotide
  Description of Combined DNA/RNA Molecule: Synthetic oligonucleotide
uuacucauccaugugaccaugagga

SEQ ID NO: 447 - DNA, 25 bp, Artificial Sequence
  Description of Artificial Sequence: Synthetic oligonucleotide
  Description of Combined DNA/RNA Molecule: Synthetic oligonucleotide
acucauccaugugaccaugaggaaa

SEQ ID NO: 448 - DNA, 25 bp, Artificial Sequence
  Description of Artificial Sequence: Synthetic oligonucleotide
  Description of Combined DNA/RNA Molecule: Synthetic oligonucleotide
ucauccaugugaccaugaggaaatg

SEQ ID NO: 449 - DNA, 25 bp, Artificial Sequence
  Description of Artificial Sequence: Synthetic oligonucleotide
  Description of Combined DNA/RNA Molecule: Synthetic oligonucleotide
auccaugugaccaugaggaaaugag

SEQ ID NO: 450 - DNA, 25 bp, Artificial Sequence
  Description of Artificial Sequence: Synthetic oligonucleotide
  Description of Combined DNA/RNA Molecule: Synthetic oligonucleotide
ccaugugaccaugaggaaaugagag

SEQ ID NO: 451 - DNA, 25 bp, Artificial Sequence
  Description of Artificial Sequence: Synthetic oligonucleotide
  Description of Combined DNA/RNA Molecule: Synthetic oligonucleotide
augugaccaugaggaaaugagagaa

SEQ ID NO: 452 - DNA, 25 bp, Artificial Sequence
  Description of Artificial Sequence: Synthetic oligonucleotide
  Description of Combined DNA/RNA Molecule: Synthetic oligonucleotide
gugaccaugaggaaaugagagaaat

SEQ ID NO: 453 - DNA, 25 bp, Artificial Sequence
  Description of Artificial Sequence: Synthetic oligonucleotide
  Description of Combined DNA/RNA Molecule: Synthetic oligonucleotide
gaccaugaggaaaugagagaaaugc

SEQ ID NO: 454 - DNA, 25 bp, Artificial Sequence
  Description of Artificial Sequence: Synthetic oligonucleotide
  Description of Combined DNA/RNA Molecule: Synthetic oligonucleotide
ccaugaggaaaugagagaaaugctt

SEQ ID NO: 455 - DNA, 25 bp, Artificial Sequence
  Description of Artificial Sequence: Synthetic oligonucleotide
  Description of Combined DNA/RNA Molecule: Synthetic oligonucleotide
augaggaaaugagagaaaugcuuac

SEQ ID NO: 456 - DNA, 25 bp, Artificial Sequence
  Description of Artificial Sequence: Synthetic oligonucleotide
  Description of Combined DNA/RNA Molecule: Synthetic oligonucleotide
gaggaaaugagagaaaugcuuacac

SEQ ID NO: 457 - DNA, 25 bp, Artificial Sequence
  Description of Artificial Sequence: Synthetic oligonucleotide
  Description of Combined DNA/RNA Molecule: Synthetic oligonucleotide
cgaagcuuuuuucucagaaugaagt

SEQ ID NO: 458 - DNA, 25 bp, Artificial Sequence
  Description of Artificial Sequence: Synthetic oligonucleotide
  Description of Combined DNA/RNA Molecule: Synthetic oligonucleotide
gcuuuuuucucagaaugaaguguac

SEQ ID NO: 459 - DNA, 25 bp, Artificial Sequence
  Description of Artificial Sequence: Synthetic oligonucleotide
  Description of Combined DNA/RNA Molecule: Synthetic oligonucleotide
uuuuuucucagaaugaaguguaccc

SEQ ID NO: 460 - DNA, 25 bp, Artificial Sequence
  Description of Artificial Sequence: Synthetic oligonucleotide
  Description of Combined DNA/RNA Molecule: Synthetic oligonucleotide
uaugauaccaacaguaaccaacctc

SEQ ID NO: 461 - DNA, 25 bp, Artificial Sequence
  Description of Artificial Sequence: Synthetic oligonucleotide
  Description of Combined DNA/RNA Molecule: Synthetic oligonucleotide
ugauaccaacaguaaccaaccucag

SEQ ID NO: 462 - DNA, 25 bp, Artificial Sequence
  Description of Artificial Sequence: Synthetic oligonucleotide
  Description of Combined DNA/RNA Molecule: Synthetic oligonucleotide
auaccaacaguaaccaaccucagtg

SEQ ID NO: 463 - DNA, 25 bp, Artificial Sequence
  Description of Artificial Sequence: Synthetic oligonucleotide
  Description of Combined DNA/RNA Molecule: Synthetic oligonucleotide
accaacaguaaccaaccucagugtg

SEQ ID NO: 464 - DNA, 25 bp, Artificial Sequence
  Description of Artificial Sequence: Synthetic oligonucleotide
  Description of Combined DNA/RNA Molecule: Synthetic oligonucleotide
caacaguaaccaaccucaguguggg

SEQ ID NO: 465 - DNA, 25 bp, Artificial Sequence
  Description of Artificial Sequence: Synthetic oligonucleotide
  Description of Combined DNA/RNA Molecule: Synthetic oligonucleotide
acaguaaccaaccucagugugggta

SEQ ID NO: 466 - DNA, 25 bp, Artificial Sequence
  Description of Artificial Sequence: Synthetic oligonucleotide
  Description of Combined DNA/RNA Molecule: Synthetic oligonucleotide
aguaaccaaccucaguguggguata

SEQ ID NO: 467 - DNA, 25 bp, Artificial Sequence
  Description of Artificial Sequence: Synthetic oligonucleotide
  Description of Combined DNA/RNA Molecule: Synthetic oligonucleotide
uaaccaaccucaguguggguauaag

SEQ ID NO: 468 - DNA, 25 bp, Artificial Sequence
  Description of Artificial Sequence: Synthetic oligonucleotide
  Description of Combined DNA/RNA Molecule: Synthetic oligonucleotide
accaaccucaguguggguauaagaa

SEQ ID NO: 469 - DNA, 25 bp, Artificial Sequence
  Description of Artificial Sequence: Synthetic oligonucleotide
  Description of Combined DNA/RNA Molecule: Synthetic oligonucleotide
ccuaugaccugcuuggugcugautt

SEQ ID NO: 470 - DNA, 25 bp, Artificial Sequence
  Description of Artificial Sequence: Synthetic oligonucleotide
  Description of Combined DNA/RNA Molecule: Synthetic oligonucleotide
cuaugaccugcuuggugcugauutg

SEQ ID NO: 471 - DNA, 25 bp, Artificial Sequence
  Description of Artificial Sequence: Synthetic oligonucleotide
  Description of Combined DNA/RNA Molecule: Synthetic oligonucleotide
augaccugcuuggugcugauuugtg

SEQ ID NO: 472 - DNA, 25 bp, Artificial Sequence
  Description of Artificial Sequence: Synthetic oligonucleotide
  Description of Combined DNA/RNA Molecule: Synthetic oligonucleotide
gcuuggugcugauuugugaacccat

SEQ ID NO: 473 - DNA, 25 bp, Artificial Sequence
  Description of Artificial Sequence: Synthetic oligonucleotide
  Description of Combined DNA/RNA Molecule: Synthetic oligonucleotide
uuggugcugauuugugaacccautc

SEQ ID NO: 474 - DNA, 25 bp, Artificial Sequence
  Description of Artificial Sequence: Synthetic oligonucleotide
  Description of Combined DNA/RNA Molecule: Synthetic oligonucleotide
ggugcugauuugugaacccauucct

SEQ ID NO: 475 - DNA, 25 bp, Artificial Sequence
  Description of Artificial Sequence: Synthetic oligonucleotide
  Description of Combined DNA/RNA Molecule: Synthetic oligonucleotide
ugcugauuugugaacccauuccuca

SEQ ID NO: 476 - DNA, 25 bp, Artificial Sequence
  Description of Artificial Sequence: Synthetic oligonucleotide
  Description of Combined DNA/RNA Molecule: Synthetic oligonucleotide
cugauuugugaacccauuccucacc

SEQ ID NO: 477 - DNA, 25 bp, Artificial Sequence
  Description of Artificial Sequence: Synthetic oligonucleotide
  Description of Combined DNA/RNA Molecule: Synthetic oligonucleotide
gauuugugaacccauuccucaccca

SEQ ID NO: 478 - DNA, 25 bp, Artificial Sequence
  Description of Artificial Sequence: Synthetic oligonucleotide
  Description of Combined DNA/RNA Molecule: Synthetic oligonucleotide
uuugugaacccauuccucacccatc

SEQ ID NO: 479 - DNA, 25 bp, Artificial Sequence
  Description of Artificial Sequence: Synthetic oligonucleotide
  Description of Combined DNA/RNA Molecule: Synthetic oligonucleotide
caaauauugaaauuccuuuagauag

SEQ ID NO: 480 - DNA, 25 bp, Artificial Sequence
  Description of Artificial Sequence: Synthetic oligonucleotide
  Description of Combined DNA/RNA Molecule: Synthetic oligonucleotide
aauauugaaauuccuuuagauagca

SEQ ID NO: 481 - DNA, 25 bp, Artificial Sequence
  Description of Artificial Sequence: Synthetic oligonucleotide
  Description of Combined DNA/RNA Molecule: Synthetic oligonucleotide
uauugaaauuccuuuagauagcaag

SEQ ID NO: 482 - DNA, 25 bp, Artificial Sequence
  Description of Artificial Sequence: Synthetic oligonucleotide
  Description of Combined DNA/RNA Molecule: Synthetic oligonucleotide
uugaaauuccuuuagauagcaagac

SEQ ID NO: 483 - DNA, 25 bp, Artificial Sequence
  Description of Artificial Sequence: Synthetic oligonucleotide
  Description of Combined DNA/RNA Molecule: Synthetic oligonucleotide
gaaauuccuuuagauagcaagactt

SEQ ID NO: 484 - DNA, 25 bp, Artificial Sequence
  Description of Artificial Sequence: Synthetic oligonucleotide
  Description of Combined DNA/RNA Molecule: Synthetic oligonucleotide
aauuccuuuagauagcaagacuutc

SEQ ID NO: 485 - DNA, 25 bp, Artificial Sequence
  Description of Artificial Sequence: Synthetic oligonucleotide
  Description of Combined DNA/RNA Molecule: Synthetic oligonucleotide
uuccuuuagauagcaagacuuucct

SEQ ID NO: 486 - DNA, 25 bp, Artificial Sequence
  Description of Artificial Sequence: Synthetic oligonucleotide
  Description of Combined DNA/RNA Molecule: Synthetic oligonucleotide
cagccuggauaugaaauuuucuuat

SEQ ID NO: 487 - DNA, 25 bp, Artificial Sequence
  Description of Artificial Sequence: Synthetic oligonucleotide
  Description of Combined DNA/RNA Molecule: Synthetic oligonucleotide
auaugaaauuuucuuauugugauga

SEQ ID NO: 488 - DNA, 25 bp, Artificial Sequence
  Description of Artificial Sequence: Synthetic oligonucleotide
  Description of Combined DNA/RNA Molecule: Synthetic oligonucleotide
gccgcucaauuuaugaauauuauca

SEQ ID NO: 489 - DNA, 25 bp, Artificial Sequence
  Description of Artificial Sequence: Synthetic oligonucleotide
  Description of Combined DNA/RNA Molecule: Synthetic oligonucleotide
cgcucaauuuaugaauauuaucatg

SEQ ID NO: 490 - DNA, 25 bp, Artificial Sequence
  Description of Artificial Sequence: Synthetic oligonucleotide
  Description of Combined DNA/RNA Molecule: Synthetic oligonucleotide
cucaauuuaugaauauuaucaugct

SEQ ID NO: 491 - DNA, 25 bp, Artificial Sequence
  Description of Artificial Sequence: Synthetic oligonucleotide
  Description of Combined DNA/RNA Molecule: Synthetic oligonucleotide
caauuuaugaauauuaucaugcutt

SEQ ID NO: 492 - DNA, 25 bp, Artificial Sequence
  Description of Artificial Sequence: Synthetic oligonucleotide
  Description of Combined DNA/RNA Molecule: Synthetic oligonucleotide
auuuaugaauauuaucaugcuuugg

SEQ ID NO: 493 - DNA, 25 bp, Artificial Sequence
  Description of Artificial Sequence: Synthetic oligonucleotide
  Description of Combined DNA/RNA Molecule: Synthetic oligonucleotide
uuaugaauauuaucaugcuuuggac

SEQ ID NO: 494 - DNA, 25 bp, Artificial Sequence
  Description of Artificial Sequence: Synthetic oligonucleotide
  Description of Combined DNA/RNA Molecule: Synthetic oligonucleotide
augaauauuaucaugcuuuggactc

SEQ ID NO: 495 - DNA, 25 bp, Artificial Sequence
  Description of Artificial Sequence: Synthetic oligonucleotide
  Description of Combined DNA/RNA Molecule: Synthetic oligonucleotide
gaauauuaucaugcuuuggacuctg

SEQ ID NO: 496 - DNA, 25 bp, Artificial Sequence
  Description of Artificial Sequence: Synthetic oligonucleotide
  Description of Combined DNA/RNA Molecule: Synthetic oligonucleotide
uuaucaugcuuuggacucugaucat

SEQ ID NO: 497 - DNA, 25 bp, Artificial Sequence
  Description of Artificial Sequence: Synthetic oligonucleotide
  Description of Combined DNA/RNA Molecule: Synthetic oligonucleotide
ucaugcuuuggacucugaucauctg

SEQ ID NO: 498 - DNA, 25 bp, Artificial Sequence
  Description of Artificial Sequence: Synthetic oligonucleotide
  Description of Combined DNA/RNA Molecule: Synthetic oligonucleotide
ugcuuuggacucugaucaucugacc

SEQ ID NO: 499 - DNA, 25 bp, Artificial Sequence
  Description of Artificial Sequence: Synthetic oligonucleotide
  Description of Combined DNA/RNA Molecule: Synthetic oligonucleotide
uuuggacucugaucaucugaccaaa

SEQ ID NO: 500 - DNA, 25 bp, Artificial Sequence
  Description of Artificial Sequence: Synthetic oligonucleotide
  Description of Combined DNA/RNA Molecule: Synthetic oligonucleotide
ucugaucaucugaccaaaacucatc

SEQ ID NO: 501 - DNA, 25 bp, Artificial Sequence
  Description of Artificial Sequence: Synthetic oligonucleotide
  Description of Combined DNA/RNA Molecule: Synthetic oligonucleotide
ugaucaucugaccaaaacucaucat

SEQ ID NO: 502 - DNA, 25 bp, Artificial Sequence
  Description of Artificial Sequence: Synthetic oligonucleotide
  Description of Combined DNA/RNA Molecule: Synthetic oligonucleotide
aucaucugaccaaaacucaucauga

SEQ ID NO: 503 - DNA, 25 bp, Artificial Sequence
  Description of Artificial Sequence: Synthetic oligonucleotide
  Description of Combined DNA/RNA Molecule: Synthetic oligonucleotide
augauauguuuacuaaaggacaagt

SEQ ID NO: 504 - DNA, 25 bp, Artificial Sequence
  Description of Artificial Sequence: Synthetic oligonucleotide
  Description of Combined DNA/RNA Molecule: Synthetic oligonucleotide
gauauguuuacuaaaggacaaguca

SEQ ID NO: 505 - DNA, 25 bp, Artificial Sequence
  Description of Artificial Sequence: Synthetic oligonucleotide
  Description of Combined DNA/RNA Molecule: Synthetic oligonucleotide
uauguuuacuaaaggacaagucacc

SEQ ID NO: 506 - DNA, 25 bp, Artificial Sequence
  Description of Artificial Sequence: Synthetic oligonucleotide
  Description of Combined DNA/RNA Molecule: Synthetic oligonucleotide
uguuuacuaaaggacaagucaccac

SEQ ID NO: 507 - DNA, 25 bp, Artificial Sequence
  Description of Artificial Sequence: Synthetic oligonucleotide
  Description of Combined DNA/RNA Molecule: Synthetic oligonucleotide
uuuacuaaaggacaagucaccacag

SEQ ID NO: 508 - DNA, 25 bp, Artificial Sequence
  Description of Artificial Sequence: Synthetic oligonucleotide
  Description of Combined DNA/RNA Molecule: Synthetic oligonucleotide
uacuaaaggacaagucaccacagga

SEQ ID NO: 509 - DNA, 25 bp, Artificial Sequence
  Description of Artificial Sequence: Synthetic oligonucleotide
  Description of Combined DNA/RNA Molecule: Synthetic oligonucleotide
cuaaaggacaagucaccacaggaca

SEQ ID NO: 510 - DNA, 25 bp, Artificial Sequence
  Description of Artificial Sequence: Synthetic oligonucleotide
  Description of Combined DNA/RNA Molecule: Synthetic oligonucleotide
aaaggacaagucaccacaggacagt

SEQ ID NO: 511 - DNA, 25 bp, Artificial Sequence
  Description of Artificial Sequence: Synthetic oligonucleotide
  Description of Combined DNA/RNA Molecule: Synthetic oligonucleotide
aggacaagucaccacaggacaguac

SEQ ID NO: 512 - DNA, 25 bp, Artificial Sequence
  Description of Artificial Sequence: Synthetic oligonucleotide
  Description of Combined DNA/RNA Molecule: Synthetic oligonucleotide
gacaagucaccacaggacaguacag

SEQ ID NO: 513 - DNA, 25 bp, Artificial Sequence
  Description of Artificial Sequence: Synthetic oligonucleotide
  Description of Combined DNA/RNA Molecule: Synthetic oligonucleotide
caagucaccacaggacaguacagga

SEQ ID NO: 514 - DNA, 25 bp, Artificial Sequence
  Description of Artificial Sequence: Synthetic oligonucleotide
  Description of Combined DNA/RNA Molecule: Synthetic oligonucleotide
agucaccacaggacaguacaggatg

SEQ ID NO: 515 - DNA, 25 bp, Artificial Sequence
  Description of Artificial Sequence: Synthetic oligonucleotide
  Description of Combined DNA/RNA Molecule: Synthetic oligonucleotide
ucaccacaggacaguacaggaugct

SEQ ID NO: 516 - DNA, 25 bp, Artificial Sequence
  Description of Artificial Sequence: Synthetic oligonucleotide
  Description of Combined DNA/RNA Molecule: Synthetic oligonucleotide
accacaggacaguacaggaugcutg

SEQ ID NO: 517 - DNA, 25 bp, Artificial Sequence
  Description of Artificial Sequence: Synthetic oligonucleotide
  Description of Combined DNA/RNA Molecule: Synthetic oligonucleotide
cacaggacaguacaggaugcuugcc

SEQ ID NO: 518 - DNA, 25 bp, Artificial Sequence
  Description of Artificial Sequence: Synthetic oligonucleotide
  Description of Combined DNA/RNA Molecule: Synthetic oligonucleotide
caggacaguacaggaugcuugccaa

SEQ ID NO: 519 - DNA, 25 bp, Artificial Sequence
  Description of Artificial Sequence: Synthetic oligonucleotide
  Description of Combined DNA/RNA Molecule: Synthetic oligonucleotide
ggacaguacaggaugcuugccaaaa

SEQ ID NO: 520 - DNA, 25 bp, Artificial Sequence
  Description of Artificial Sequence: Synthetic oligonucleotide
  Description of Combined DNA/RNA Molecule: Synthetic oligonucleotide
acaguacaggaugcuugccaaaaga

SEQ ID NO: 521 - DNA, 25 bp, Artificial Sequence
  Description of Artificial Sequence: Synthetic oligonucleotide
  Description of Combined DNA/RNA Molecule: Synthetic oligonucleotide
aguacaggaugcuugccaaaagagg

SEQ ID NO: 522 - DNA, 25 bp, Artificial Sequence
  Description of Artificial Sequence: Synthetic oligonucleotide
  Description of Combined DNA/RNA Molecule: Synthetic oligonucleotide
uacaggaugcuugccaaaagaggtg

SEQ ID NO: 523 - DNA, 25 bp, Artificial Sequence
  Description of Artificial Sequence: Synthetic oligonucleotide
  Description of Combined DNA/RNA Molecule: Synthetic oligonucleotide
caggaugcuugccaaaagaggugga

SEQ ID NO: 524 - DNA, 25 bp, Artificial Sequence
  Description of Artificial Sequence: Synthetic oligonucleotide
  Description of Combined DNA/RNA Molecule: Synthetic oligonucleotide
ggaugcuugccaaaagagguggata

SEQ ID NO: 525 - DNA, 25 bp, Artificial Sequence
  Description of Artificial Sequence: Synthetic oligonucleotide
  Description of Combined DNA/RNA Molecule: Synthetic oligonucleotide
augcuugccaaaagagguggauatg

SEQ ID NO: 526 - DNA, 25 bp, Artificial Sequence
  Description of Artificial Sequence: Synthetic oligonucleotide
  Description of Combined DNA/RNA Molecule: Synthetic oligonucleotide
gcuugccaaaagagguggauaugtc

SEQ ID NO: 527 - DNA, 25 bp, Artificial Sequence
  Description of Artificial Sequence: Synthetic oligonucleotide
  Description of Combined DNA/RNA Molecule: Synthetic oligonucleotide
uugccaaaagagguggauauguctg

SEQ ID NO: 528 - DNA, 25 bp, Artificial Sequence
  Description of Artificial Sequence: Synthetic oligonucleotide
  Description of Combined DNA/RNA Molecule: Synthetic oligonucleotide
gccaaaagagguggauaugucuggg

SEQ ID NO: 529 - DNA, 25 bp, Artificial Sequence
  Description of Artificial Sequence: Synthetic oligonucleotide
  Description of Combined DNA/RNA Molecule: Synthetic oligonucleotide
caaaagagguggauaugucugggtt

SEQ ID NO: 530 - DNA, 25 bp, Artificial Sequence
  Description of Artificial Sequence: Synthetic oligonucleotide
  Description of Combined DNA/RNA Molecule: Synthetic oligonucleotide
aaagagguggauaugucuggguuga

SEQ ID NO: 531 - DNA, 25 bp, Artificial Sequence
  Description of Artificial Sequence: Synthetic oligonucleotide
  Description of Combined DNA/RNA Molecule: Synthetic oligonucleotide
agagguggauaugucuggguugaaa

SEQ ID NO: 532 - DNA, 25 bp, Artificial Sequence
  Description of Artificial Sequence: Synthetic oligonucleotide
  Description of Combined DNA/RNA Molecule: Synthetic oligonucleotide
agguggauaugucuggguugaaact

SEQ ID NO: 533 - DNA, 25 bp, Artificial Sequence
  Description of Artificial Sequence: Synthetic oligonucleotide
  Description of Combined DNA/RNA Molecule: Synthetic oligonucleotide
guggauaugucuggguugaaacuca

SEQ ID NO: 534 - DNA, 25 bp, Artificial Sequence
  Description of Artificial Sequence: Synthetic oligonucleotide
  Description of Combined DNA/RNA Molecule: Synthetic oligonucleotide
ggauaugucuggguugaaacucaag

SEQ ID NO: 535 - DNA, 25 bp, Artificial Sequence
  Description of Artificial Sequence: Synthetic oligonucleotide
  Description of Combined DNA/RNA Molecule: Synthetic oligonucleotide
auaugucuggguugaaacucaagca

SEQ ID NO: 536 - DNA, 25 bp, Artificial Sequence
  Description of Artificial Sequence: Synthetic oligonucleotide
  Description of Combined DNA/RNA Molecule: Synthetic oligonucleotide
augucuggguugaaacucaagcaac

SEQ ID NO: 537 - DNA, 25 bp, Artificial Sequence
  Description of Artificial Sequence: Synthetic oligonucleotide
  Description of Combined DNA/RNA Molecule: Synthetic oligonucleotide
gucuggguugaaacucaagcaactg

SEQ ID NO: 538 - DNA, 25 bp, Artificial Sequence
  Description of Artificial Sequence: Synthetic oligonucleotide
  Description of Combined DNA/RNA Molecule: Synthetic oligonucleotide
cuggguugaaacucaagcaacugtc

SEQ ID NO: 539 - DNA, 25 bp, Artificial Sequence
  Description of Artificial Sequence: Synthetic oligonucleotide
  Description of Combined DNA/RNA Molecule: Synthetic oligonucleotide
ggguugaaacucaagcaacugucat

SEQ ID NO: 540 - DNA, 25 bp, Artificial Sequence
  Description of Artificial Sequence: Synthetic oligonucleotide
  Description of Combined DNA/RNA Molecule: Synthetic oligonucleotide
guugaaacucaagcaacugucauat

SEQ ID NO: 541 - DNA, 25 bp, Artificial Sequence
  Description of Artificial Sequence: Synthetic oligonucleotide
  Description of Combined DNA/RNA Molecule: Synthetic oligonucleotide
ugaaacucaagcaacugucauauat

SEQ ID NO: 542 - DNA, 25 bp, Artificial Sequence
  Description of Artificial Sequence: Synthetic oligonucleotide
  Description of Combined DNA/RNA Molecule: Synthetic oligonucleotide
aaacucaagcaacugucauauauaa

SEQ ID NO: 543 - DNA, 25 bp, Artificial Sequence
  Description of Artificial Sequence: Synthetic oligonucleotide
  Description of Combined DNA/RNA Molecule: Synthetic oligonucleotide
acucaagcaacugucauauauaaca

SEQ ID NO: 544 - DNA, 25 bp, Artificial Sequence
  Description of Artificial Sequence: Synthetic oligonucleotide
  Description of Combined DNA/RNA Molecule: Synthetic oligonucleotide
ucaagcaacugucauauauaacacc

SEQ ID NO: 545 - DNA, 25 bp, Artificial Sequence
  Description of Artificial Sequence: Synthetic oligonucleotide
  Description of Combined DNA/RNA Molecule: Synthetic oligonucleotide
aagcaacugucauauauaacaccaa

SEQ ID NO: 546 - DNA, 25 bp, Artificial Sequence
  Description of Artificial Sequence: Synthetic oligonucleotide
  Description of Combined DNA/RNA Molecule: Synthetic oligonucleotide
gugguauuauucagcacgacuugat

SEQ ID NO: 547 - DNA, 25 bp, Artificial Sequence
  Description of Artificial Sequence: Synthetic oligonucleotide
  Description of Combined DNA/RNA Molecule: Synthetic oligonucleotide
gguauuauucagcacgacuugautt

SEQ ID NO: 548 - DNA, 25 bp, Artificial Sequence
  Description of Artificial Sequence: Synthetic oligonucleotide
  Description of Combined DNA/RNA Molecule: Synthetic oligonucleotide
uauuauucagcacgacuugauuutc

SEQ ID NO: 549 - DNA, 25 bp, Artificial Sequence
  Description of Artificial Sequence: Synthetic oligonucleotide
  Description of Combined DNA/RNA Molecule: Synthetic oligonucleotide
uuauucagcacgacuugauuuuctc

SEQ ID NO: 550 - DNA, 25 bp, Artificial Sequence
  Description of Artificial Sequence: Synthetic oligonucleotide
  Description of Combined DNA/RNA Molecule: Synthetic oligonucleotide
auucagcacgacuugauuuucuccc

SEQ ID NO: 551 - DNA, 25 bp, Artificial Sequence
  Description of Artificial Sequence: Synthetic oligonucleotide
  Description of Combined DNA/RNA Molecule: Synthetic oligonucleotide
ucagcacgacuugauuuucuccctt

SEQ ID NO: 552 - DNA, 25 bp, Artificial Sequence
  Description of Artificial Sequence: Synthetic oligonucleotide
  Description of Combined DNA/RNA Molecule: Synthetic oligonucleotide
agcacgacuugauuuucucccuuca

SEQ ID NO: 553 - DNA, 25 bp, Artificial Sequence
  Description of Artificial Sequence: Synthetic oligonucleotide
  Description of Combined DNA/RNA Molecule: Synthetic oligonucleotide
cacgacuugauuuucucccuucaac

SEQ ID NO: 554 - DNA, 25 bp, Artificial Sequence
  Description of Artificial Sequence: Synthetic oligonucleotide
  Description of Combined DNA/RNA Molecule: Synthetic oligonucleotide
cgacuugauuuucucccuucaacaa

SEQ ID NO: 555 - DNA, 25 bp, Artificial Sequence
  Description of Artificial Sequence: Synthetic oligonucleotide
  Description of Combined DNA/RNA Molecule: Synthetic oligonucleotide
acuugauuuucucccuucaacaaac

SEQ ID NO: 556 - DNA, 25 bp, Artificial Sequence
  Description of Artificial Sequence: Synthetic oligonucleotide
  Description of Combined DNA/RNA Molecule: Synthetic oligonucleotide
uugauuuucucccuucaacaaacag

SEQ ID NO: 557 - DNA, 25 bp, Artificial Sequence
  Description of Artificial Sequence: Synthetic oligonucleotide
  Description of Combined DNA/RNA Molecule: Synthetic oligonucleotide
gauuuucucccuucaacaaacagaa

SEQ ID NO: 558 - DNA, 25 bp, Artificial Sequence
  Description of Artificial Sequence: Synthetic oligonucleotide
  Description of Combined DNA/RNA Molecule: Synthetic oligonucleotide
uuuucucccuucaacaaacagaatg

SEQ ID NO: 559 - DNA, 25 bp, Artificial Sequence
  Description of Artificial Sequence: Synthetic oligonucleotide
  Description of Combined DNA/RNA Molecule: Synthetic oligonucleotide
uucucccuucaacaaacagaaugtg

SEQ ID NO: 560 - DNA, 25 bp, Artificial Sequence
  Description of Artificial Sequence: Synthetic oligonucleotide
  Description of Combined DNA/RNA Molecule: Synthetic oligonucleotide
uugaaucuucagauaugaaaaugac

SEQ ID NO: 561 - DNA, 25 bp, Artificial Sequence
  Description of Artificial Sequence: Synthetic oligonucleotide
  Description of Combined DNA/RNA Molecule: Synthetic oligonucleotide
ucaccaaaguugaaucagaagauac

SEQ ID NO: 562 - DNA, 25 bp, Artificial Sequence
  Description of Artificial Sequence: Synthetic oligonucleotide
  Description of Combined DNA/RNA Molecule: Synthetic oligonucleotide
gauacaaguagccucuuugacaaac

SEQ ID NO: 563 - DNA, 25 bp, Artificial Sequence
  Description of Artificial Sequence: Synthetic oligonucleotide
  Description of Combined DNA/RNA Molecule: Synthetic oligonucleotide
caaucauaucuuuagauuuuggcag

SEQ ID NO: 564 - DNA, 25 bp, Artificial Sequence
  Description of Artificial Sequence: Synthetic oligonucleotide
  Description of Combined DNA/RNA Molecule: Synthetic oligonucleotide
aguaccauuauauaaugauguaatg

SEQ ID NO: 565 - DNA, 25 bp, Artificial Sequence
  Description of Artificial Sequence: Synthetic oligonucleotide
  Description of Combined DNA/RNA Molecule: Synthetic oligonucleotide
cauuauauaaugauguaaugcuccc

SEQ ID NO: 566 - DNA, 25 bp, Artificial Sequence
  Description of Artificial Sequence: Synthetic oligonucleotide
  Description of Combined DNA/RNA Molecule: Synthetic oligonucleotide
uacccaccgcugaaacgccaaagcc

SEQ ID NO: 567 - DNA, 25 bp, Artificial Sequence
  Description of Artificial Sequence: Synthetic oligonucleotide
  Description of Combined DNA/RNA Molecule: Synthetic oligonucleotide
caaagccacuucgaaguagugcuga

SEQ ID NO: 568 - DNA, 25 bp, Artificial Sequence
  Description of Artificial Sequence: Synthetic oligonucleotide
  Description of Combined DNA/RNA Molecule: Synthetic oligonucleotide
aagccacuucgaaguagugcugacc

SEQ ID NO: 569 - DNA, 25 bp, Artificial Sequence
  Description of Artificial Sequence: Synthetic oligonucleotide
  Description of Combined DNA/RNA Molecule: Synthetic oligonucleotide
gccacuucgaaguagugcugaccct

SEQ ID NO: 570 - DNA, 25 bp, Artificial Sequence
  Description of Artificial Sequence: Synthetic oligonucleotide
  Description of Combined DNA/RNA Molecule: Synthetic oligonucleotide
cacuucgaaguagugcugacccugc

SEQ ID NO: 571 - DNA, 25 bp, Artificial Sequence
  Description of Artificial Sequence: Synthetic oligonucleotide
  Description of Combined DNA/RNA Molecule: Synthetic oligonucleotide
ucgaaguagugcugacccugcactc

SEQ ID NO: 572 - DNA, 25 bp, Artificial Sequence
  Description of Artificial Sequence: Synthetic oligonucleotide
  Description of Combined DNA/RNA Molecule: Synthetic oligonucleotide
gaaguugcauuaaaauuagaaccaa

SEQ ID NO: 573 - DNA, 25 bp, Artificial Sequence
  Description of Artificial Sequence: Synthetic oligonucleotide
  Description of Combined DNA/RNA Molecule: Synthetic oligonucleotide
auggaagcacuagacaaaguucacc

SEQ ID NO: 574 - DNA, 25 bp, Artificial Sequence
  Description of Artificial Sequence: Synthetic oligonucleotide
  Description of Combined DNA/RNA Molecule: Synthetic oligonucleotide
ggaagcacuagacaaaguucacctg

SEQ ID NO: 575 - DNA, 25 bp, Artificial Sequence
  Description of Artificial Sequence: Synthetic oligonucleotide
  Description of Combined DNA/RNA Molecule: Synthetic oligonucleotide
aagcacuagacaaaguucaccugag

SEQ ID NO: 576 - DNA, 25 bp, Artificial Sequence
  Description of Artificial Sequence: Synthetic oligonucleotide
  Description of Combined DNA/RNA Molecule: Synthetic oligonucleotide
gcacuagacaaaguucaccugagcc

SEQ ID NO: 577 - DNA, 25 bp, Artificial Sequence
  Description of Artificial Sequence: Synthetic oligonucleotide
  Description of Combined DNA/RNA Molecule: Synthetic oligonucleotide
acuagacaaaguucaccugagccta

SEQ ID NO: 578 - DNA, 25 bp, Artificial Sequence
  Description of Artificial Sequence: Synthetic oligonucleotide
  Description of Combined DNA/RNA Molecule: Synthetic oligonucleotide
uagacaaaguucaccugagccuaat

SEQ ID NO: 579 - DNA, 25 bp, Artificial Sequence
  Description of Artificial Sequence: Synthetic oligonucleotide
  Description of Combined DNA/RNA Molecule: Synthetic oligonucleotide
agugaauauuguuuuuauguggata

SEQ ID NO: 580 - DNA, 25 bp, Artificial Sequence
  Description of Artificial Sequence: Synthetic oligonucleotide
  Description of Combined DNA/RNA Molecule: Synthetic oligonucleotide
uuguuuuuauguggauagugauatg

SEQ ID NO: 581 - DNA, 25 bp, Artificial Sequence
  Description of Artificial Sequence: Synthetic oligonucleotide
  Description of Combined DNA/RNA Molecule: Synthetic oligonucleotide
guagaaaaacuuuuugcugaagaca

SEQ ID NO: 582 - DNA, 25 bp, Artificial Sequence
  Description of Artificial Sequence: Synthetic oligonucleotide
  Description of Combined DNA/RNA Molecule: Synthetic oligonucleotide
cucccuauaucccaauggaugauga

SEQ ID NO: 583 - DNA, 25 bp, Artificial Sequence
  Description of Artificial Sequence: Synthetic oligonucleotide
  Description of Combined DNA/RNA Molecule: Synthetic oligonucleotide
cccuauaucccaauggaugaugact

SEQ ID NO: 584 - DNA, 25 bp, Artificial Sequence
  Description of Artificial Sequence: Synthetic oligonucleotide
  Description of Combined DNA/RNA Molecule: Synthetic oligonucleotide
cuauaucccaauggaugaugacutc

SEQ ID NO: 585 - DNA, 25 bp, Artificial Sequence
  Description of Artificial Sequence: Synthetic oligonucleotide
  Description of Combined DNA/RNA Molecule: Synthetic oligonucleotide
auaucccaauggaugaugacuucca

SEQ ID NO: 586 - DNA, 25 bp, Artificial Sequence
  Description of Artificial Sequence: Synthetic oligonucleotide
  Description of Combined DNA/RNA Molecule: Synthetic oligonucleotide
aucaguugucaccauuagaaagcag

SEQ ID NO: 587 - DNA, 25 bp, Artificial Sequence
  Description of Artificial Sequence: Synthetic oligonucleotide
  Description of Combined DNA/RNA Molecule: Synthetic oligonucleotide
guuccgcaagcccugaaagcgcaag

SEQ ID NO: 588 - DNA, 25 bp, Artificial Sequence
  Description of Artificial Sequence: Synthetic oligonucleotide
  Description of Combined DNA/RNA Molecule: Synthetic oligonucleotide
uccgcaagcccugaaagcgcaagtc

SEQ ID NO: 589 - DNA, 25 bp, Artificial Sequence
  Description of Artificial Sequence: Synthetic oligonucleotide
  Description of Combined DNA/RNA Molecule: Synthetic oligonucleotide
cugaugaauuaaaaacagugacaaa

SEQ ID NO: 590 - DNA, 25 bp, Artificial Sequence
  Description of Artificial Sequence: Synthetic oligonucleotide
  Description of Combined DNA/RNA Molecule: Synthetic oligonucleotide
aagacauuaaaauauugauugcatc

SEQ ID NO: 591 - DNA, 25 bp, Artificial Sequence
  Description of Artificial Sequence: Synthetic oligonucleotide
  Description of Combined DNA/RNA Molecule: Synthetic oligonucleotide
gagucauagaacagacagaaaaatc

SEQ ID NO: 592 - DNA, 25 bp, Artificial Sequence
  Description of Artificial Sequence: Synthetic oligonucleotide
  Description of Combined DNA/RNA Molecule: Synthetic oligonucleotide
gauacuagcuuugcagaaugcucag

SEQ ID NO: 593 - DNA, 25 bp, Artificial Sequence
  Description of Artificial Sequence: Synthetic oligonucleotide
  Description of Combined DNA/RNA Molecule: Synthetic oligonucleotide
cagagaaagcgaaaaauggaacatg

SEQ ID NO: 594 - DNA, 25 bp, Artificial Sequence
  Description of Artificial Sequence: Synthetic oligonucleotide
  Description of Combined DNA/RNA Molecule: Synthetic oligonucleotide
agcgaaaaauggaacaugauggutc

SEQ ID NO: 595 - DNA, 25 bp, Artificial Sequence
  Description of Artificial Sequence: Synthetic oligonucleotide
  Description of Combined DNA/RNA Molecule: Synthetic oligonucleotide
cgaaaaauggaacaugaugguucac

SEQ ID NO: 596 - DNA, 25 bp, Artificial Sequence
  Description of Artificial Sequence: Synthetic oligonucleotide
  Description of Combined DNA/RNA Molecule: Synthetic oligonucleotide
agcaguaggaauuggaacauuauta

SEQ ID NO: 597 - DNA, 25 bp, Artificial Sequence
  Description of Artificial Sequence: Synthetic oligonucleotide
  Description of Combined DNA/RNA Molecule: Synthetic oligonucleotide
aucuagugaacagaauggaauggag

SEQ ID NO: 598 - DNA, 25 bp, Artificial Sequence
  Description of Artificial Sequence: Synthetic oligonucleotide
  Description of Combined DNA/RNA Molecule: Synthetic oligonucleotide
caaaagacaauuauuuuaauaccct

SEQ ID NO: 599 - DNA, 25 bp, Artificial Sequence
  Description of Artificial Sequence: Synthetic oligonucleotide
  Description of Combined DNA/RNA Molecule: Synthetic oligonucleotide
aguggauuaccacagcugaccagtt

SEQ ID NO: 600 - DNA, 25 bp, Artificial Sequence
  Description of Artificial Sequence: Synthetic oligonucleotide
  Description of Combined DNA/RNA Molecule: Synthetic oligonucleotide
uggauuaccacagcugaccaguuat

SEQ ID NO: 601 - DNA, 25 bp, Artificial Sequence
  Description of Artificial Sequence: Synthetic oligonucleotide
  Description of Combined DNA/RNA Molecule: Synthetic oligonucleotide
gauuaccacagcugaccaguuauga

SEQ ID NO: 602 - DNA, 25 bp, Artificial Sequence
  Description of Artificial Sequence: Synthetic oligonucleotide
  Description of Combined DNA/RNA Molecule: Synthetic oligonucleotide
uuaccacagcugaccaguuaugatt

SEQ ID NO: 603 - DNA, 25 bp, Artificial Sequence
  Description of Artificial Sequence: Synthetic oligonucleotide
  Description of Combined DNA/RNA Molecule: Synthetic oligonucleotide
gauugugaaguuaaugcuccuauac

SEQ ID NO: 604 - DNA, 25 bp, Artificial Sequence
  Description of Artificial Sequence: Synthetic oligonucleotide
  Description of Combined DNA/RNA Molecule: Synthetic oligonucleotide
auacaaggcagcagaaaccuacugc

SEQ ID NO: 605 - DNA, 25 bp, Artificial Sequence
  Description of Artificial Sequence: Synthetic oligonucleotide
  Description of Combined DNA/RNA Molecule: Synthetic oligonucleotide
acaaggcagcagaaaccuacugcag

SEQ ID NO: 606 - DNA, 25 bp, Artificial Sequence
  Description of Artificial Sequence: Synthetic oligonucleotide
  Description of Combined DNA/RNA Molecule: Synthetic oligonucleotide
aaggcagcagaaaccuacugcaggg

SEQ ID NO: 607 - DNA, 25 bp, Artificial Sequence
  Description of Artificial Sequence: Synthetic oligonucleotide
  Description of Combined DNA/RNA Molecule: Synthetic oligonucleotide
ggcagcagaaaccuacugcagggtg

SEQ ID NO: 608 - DNA, 25 bp, Artificial Sequence
  Description of Artificial Sequence: Synthetic oligonucleotide
  Description of Combined DNA/RNA Molecule: Synthetic oligonucleotide
cagcagaaaccuacugcagggugaa

SEQ ID NO: 609 - DNA, 25 bp, Artificial Sequence
  Description of Artificial Sequence: Synthetic oligonucleotide
  Description of Combined DNA/RNA Molecule: Synthetic oligonucleotide
gcagaaaccuacugcagggugaaga

SEQ ID NO: 610 - DNA, 25 bp, Artificial Sequence
  Description of Artificial Sequence: Synthetic oligonucleotide
  Description of Combined DNA/RNA Molecule: Synthetic oligonucleotide
agaaaccuacugcagggugaagaat

SEQ ID NO: 611 - DNA, 25 bp, Artificial Sequence
  Description of Artificial Sequence: Synthetic oligonucleotide
  Description of Combined DNA/RNA Molecule: Synthetic oligonucleotide
aaaccuacugcagggugaagaauta

SEQ ID NO: 612 - DNA, 25 bp, Artificial Sequence
  Description of Artificial Sequence: Synthetic oligonucleotide
  Description of Combined DNA/RNA Molecule: Synthetic oligonucleotide
accuacugcagggugaagaauuact

SEQ ID NO: 613 - DNA, 25 bp, Artificial Sequence
  Description of Artificial Sequence: Synthetic oligonucleotide
  Description of Combined DNA/RNA Molecule: Synthetic oligonucleotide
cuacugcagggugaagaauuacuca

SEQ ID NO: 614 - DNA, 25 bp, Artificial Sequence
  Description of Artificial Sequence: Synthetic oligonucleotide
  Description of Combined DNA/RNA Molecule: Synthetic oligonucleotide
acugcagggugaagaauuacucaga

SEQ ID NO: 615 - DNA, 25 bp, Artificial Sequence
  Description of Artificial Sequence: Synthetic oligonucleotide
  Description of Combined DNA/RNA Molecule: Synthetic oligonucleotide
ugcagggugaagaauuacucagagc

SEQ ID NO: 616 - DNA, 25 bp, Artificial Sequence
  Description of Artificial Sequence: Synthetic oligonucleotide
  Description of Combined DNA/RNA Molecule: Synthetic oligonucleotide
cagggugaagaauuacucagagctt

SEQ ID NO: 617 - DNA, 25 bp, Artificial Sequence
  Description of Artificial Sequence: Synthetic oligonucleotide
  Description of Combined DNA/RNA Molecule: Synthetic oligonucleotide
gggugaagaauuacucagagcuutg

SEQ ID NO: 618 - DNA, 25 bp, Artificial Sequence
  Description of Artificial Sequence: Synthetic oligonucleotide
  Description of Combined DNA/RNA Molecule: Synthetic oligonucleotide
gugaagaauuacucagagcuuugga

SEQ ID NO: 619 - DNA, 25 bp, Artificial Sequence
  Description of Artificial Sequence: Synthetic oligonucleotide
  Description of Combined DNA/RNA Molecule: Synthetic oligonucleotide
gaagaauuacucagagcuuuggatc

SEQ ID NO: 620 - DNA, 25 bp, Artificial Sequence
  Description of Artificial Sequence: Synthetic oligonucleotide
  Description of Combined DNA/RNA Molecule: Synthetic oligonucleotide
agaauuacucagagcuuuggaucaa

SEQ ID NO: 621 - DNA, 25 bp, Artificial Sequence
  Description of Artificial Sequence: Synthetic oligonucleotide
  Description of Combined DNA/RNA Molecule: Synthetic oligonucleotide
aauuacucagagcuuuggaucaagt

SEQ ID NO: 622 - DNA, 25 bp, Artificial Sequence
  Description of Artificial Sequence: Synthetic oligonucleotide
  Description of Combined DNA/RNA Molecule: Synthetic oligonucleotide
uuacucagagcuuuggaucaaguta

SEQ ID NO: 623 - DNA, 25 bp, Artificial Sequence
  Description of Artificial Sequence: Synthetic oligonucleotide
  Description of Combined DNA/RNA Molecule: Synthetic oligonucleotide
acucagagcuuuggaucaaguuaac

SEQ ID NO: 624 - DNA, 25 bp, Artificial Sequence
  Description of Artificial Sequence: Synthetic oligonucleotide
  Description of Combined DNA/RNA Molecule: Synthetic oligonucleotide
ucagagcuuuggaucaaguuaactg

SEQ ID NO: 625 - DNA, 25 bp, Artificial Sequence
  Description of Artificial Sequence: Synthetic oligonucleotide
  Description of Combined DNA/RNA Molecule: Synthetic oligonucleotide
agagcuuuggaucaaguuaacugag

SEQ ID NO: 626 - DNA, 25 bp, Artificial Sequence
  Description of Artificial Sequence: Synthetic oligonucleotide
  Description of Combined DNA/RNA Molecule: Synthetic oligonucleotide
agcuuuggaucaaguuaacugagct

SEQ ID NO: 627 - DNA, 25 bp, Artificial Sequence
  Description of Artificial Sequence: Synthetic oligonucleotide
  Description of Combined DNA/RNA Molecule: Synthetic oligonucleotide
cuuuggaucaaguuaacugagcutt

SEQ ID NO: 628 - DNA, 25 bp, Artificial Sequence
  Description of Artificial Sequence: Synthetic oligonucleotide
  Description of Combined DNA/RNA Molecule: Synthetic oligonucleotide
uuggaucaaguuaacugagcuuutt

SEQ ID NO: 629 - DNA, 25 bp, Artificial Sequence
  Description of Artificial Sequence: Synthetic oligonucleotide
  Description of Combined DNA/RNA Molecule: Synthetic oligonucleotide
gaucaaguuaacugagcuuuuuctt

SEQ ID NO: 630 - DNA, 25 bp, Artificial Sequence
  Description of Artificial Sequence: Synthetic oligonucleotide
  Description of Combined DNA/RNA Molecule: Synthetic oligonucleotide
cugagcuuuuucuuaauuucauucc

SEQ ID NO: 631 - DNA, 25 bp, Artificial Sequence
  Description of Artificial Sequence: Synthetic oligonucleotide
  Description of Combined DNA/RNA Molecule: Synthetic oligonucleotide
gcuuuuucuuaauuucauuccuutt

SEQ ID NO: 632 - DNA, 25 bp, Artificial Sequence
  Description of Artificial Sequence: Synthetic oligonucleotide
  Description of Combined DNA/RNA Molecule: Synthetic oligonucleotide
uaauuucauuccuuuuuuuggacac

SEQ ID NO: 633 - DNA, 25 bp, Artificial Sequence
  Description of Artificial Sequence: Synthetic oligonucleotide
  Description of Combined DNA/RNA Molecule: Synthetic oligonucleotide
cauuccuuuuuuuggacacuggugg

SEQ ID NO: 634 - DNA, 25 bp, Artificial Sequence
  Description of Artificial Sequence: Synthetic oligonucleotide
  Description of Combined DNA/RNA Molecule: Synthetic oligonucleotide
uuuuuggacacugguggcucauuac

SEQ ID NO: 635 - DNA, 25 bp, Artificial Sequence
  Description of Artificial Sequence: Synthetic oligonucleotide
  Description of Combined DNA/RNA Molecule: Synthetic oligonucleotide
uuuggacacugguggcucauuacct

SEQ ID NO: 636 - DNA, 25 bp, Artificial Sequence
  Description of Artificial Sequence: Synthetic oligonucleotide
  Description of Combined DNA/RNA Molecule: Synthetic oligonucleotide
gcagucuauuuauauuuucuacatc

SEQ ID NO: 637 - DNA, 25 bp, Artificial Sequence
  Description of Artificial Sequence: Synthetic oligonucleotide
  Description of Combined DNA/RNA Molecule: Synthetic oligonucleotide
agucuauuuauauuuucuacaucta

SEQ ID NO: 638 - DNA, 25 bp, Artificial Sequence
  Description of Artificial Sequence: Synthetic oligonucleotide
  Description of Combined DNA/RNA Molecule: Synthetic oligonucleotide
auuuauauuuucuacaucuaauutt

SEQ ID NO: 639 - DNA, 25 bp, Artificial Sequence
  Description of Artificial Sequence: Synthetic oligonucleotide
  Description of Combined DNA/RNA Molecule: Synthetic oligonucleotide
ucuaauuuuagaagccuggcuacaa

SEQ ID NO: 640 - DNA, 25 bp, Artificial Sequence
  Description of Artificial Sequence: Synthetic oligonucleotide
  Description of Combined DNA/RNA Molecule: Synthetic oligonucleotide
uaauuuuagaagccuggcuacaata

SEQ ID NO: 641 - DNA, 25 bp, Artificial Sequence
  Description of Artificial Sequence: Synthetic oligonucleotide
  Description of Combined DNA/RNA Molecule: Synthetic oligonucleotide
auuuuagaagccuggcuacaauact

SEQ ID NO: 642 - DNA, 25 bp, Artificial Sequence
  Description of Artificial Sequence: Synthetic oligonucleotide
  Description of Combined DNA/RNA Molecule: Synthetic oligonucleotide
uuuagaagccuggcuacaauacugc

SEQ ID NO: 643 - DNA, 25 bp, Artificial Sequence
  Description of Artificial Sequence: Synthetic oligonucleotide
  Description of Combined DNA/RNA Molecule: Synthetic oligonucleotide
uagaagccuggcuacaauacugcac

SEQ ID NO: 644 - DNA, 25 bp, Artificial Sequence
  Description of Artificial Sequence: Synthetic oligonucleotide
  Description of Combined DNA/RNA Molecule: Synthetic oligonucleotide
gaagccuggcuacaauacugcacaa

SEQ ID NO: 645 - DNA, 25 bp, Artificial Sequence
  Description of Artificial Sequence: Synthetic oligonucleotide
  Description of Combined DNA/RNA Molecule: Synthetic oligonucleotide
agccuggcuacaauacugcacaaac

SEQ ID NO: 646 - DNA, 25 bp, Artificial Sequence
  Description of Artificial Sequence: Synthetic oligonucleotide
  Description of Combined DNA/RNA Molecule: Synthetic oligonucleotide
ccuggcuacaauacugcacaaactt

SEQ ID NO: 647 - DNA, 25 bp, Artificial Sequence
  Description of Artificial Sequence: Synthetic oligonucleotide
  Description of Combined DNA/RNA Molecule: Synthetic oligonucleotide
uggcuacaauacugcacaaacuugg

SEQ ID NO: 648 - DNA, 25 bp, Artificial Sequence
  Description of Artificial Sequence: Synthetic oligonucleotide
  Description of Combined DNA/RNA Molecule: Synthetic oligonucleotide
gcuacaauacugcacaaacuuggtt

SEQ ID NO: 649 - DNA, 25 bp, Artificial Sequence
  Description of Artificial Sequence: Synthetic oligonucleotide
  Description of Combined DNA/RNA Molecule: Synthetic oligonucleotide
uaauuuacauuaaugcucuuuuuta

SEQ ID NO: 650 - DNA, 25 bp, Artificial Sequence
  Description of Artificial Sequence: Synthetic oligonucleotide
  Description of Combined DNA/RNA Molecule: Synthetic oligonucleotide
uaaugcucuuuuuuaguauguuctt

SEQ ID NO: 651 - DNA, 25 bp, Artificial Sequence
  Description of Artificial Sequence: Synthetic oligonucleotide
  Description of Combined DNA/RNA Molecule: Synthetic oligonucleotide
augcucuuuuuuaguauguucuuta

SEQ ID NO: 652 - DNA, 25 bp, Artificial Sequence
  Description of Artificial Sequence: Synthetic oligonucleotide
  Description of Combined DNA/RNA Molecule: Synthetic oligonucleotide
ugcucuuuuuuaguauguucuuuaa

SEQ ID NO: 653 - DNA, 25 bp, Artificial Sequence
  Description of Artificial Sequence: Synthetic oligonucleotide
  Description of Combined DNA/RNA Molecule: Synthetic oligonucleotide
uuaguauguucuuuaaugcuggatc

SEQ ID NO: 654 - DNA, 25 bp, Artificial Sequence
  Description of Artificial Sequence: Synthetic oligonucleotide
  Description of Combined DNA/RNA Molecule: Synthetic oligonucleotide
uauguucuuuaaugcuggaucacag

SEQ ID NO: 655 - DNA, 25 bp, Artificial Sequence
  Description of Artificial Sequence: Synthetic oligonucleotide
  Description of Combined DNA/RNA Molecule: Synthetic oligonucleotide
uuuaaugcuggaucacagacagctc

SEQ ID NO: 656 - DNA, 25 bp, Artificial Sequence
  Description of Artificial Sequence: Synthetic oligonucleotide
  Description of Combined DNA/RNA Molecule: Synthetic oligonucleotide
ugcuggaucacagacagcucauutt

SEQ ID NO: 657 - DNA, 25 bp, Artificial Sequence
  Description of Artificial Sequence: Synthetic oligonucleotide
  Description of Combined DNA/RNA Molecule: Synthetic oligonucleotide
cucauuuucucaguuuuuugguatt

SEQ ID NO: 658 - DNA, 25 bp, Artificial Sequence
  Description of Artificial Sequence: Synthetic oligonucleotide
  Description of Combined DNA/RNA Molecule: Synthetic oligonucleotide
aaaaugcaccuuuuuauuuauuuat

SEQ ID NO: 659 - DNA, 25 bp, Artificial Sequence
  Description of Artificial Sequence: Synthetic oligonucleotide
  Description of Combined DNA/RNA Molecule: Synthetic oligonucleotide
aaugcaccuuuuuauuuauuuautt

SEQ ID NO: 660 - DNA, 25 bp, Artificial Sequence
  Description of Artificial Sequence: Synthetic oligonucleotide
  Description of Combined DNA/RNA Molecule: Synthetic oligonucleotide
ugcaccuuuuuauuuauuuauuutt

SEQ ID NO: 661 - DNA, 25 bp, Artificial Sequence
  Description of Artificial Sequence: Synthetic oligonucleotide
  Description of Combined DNA/RNA Molecule: Synthetic oligonucleotide
caccuuuuuauuuauuuauuuuugg

SEQ ID NO: 662 - DNA, 25 bp, Artificial Sequence
  Description of Artificial Sequence: Synthetic oligonucleotide
  Description of Combined DNA/RNA Molecule: Synthetic oligonucleotide
ccuuuuuauuuauuuauuuuuggct

SEQ ID NO: 663 - DNA, 25 bp, Artificial Sequence
  Description of Artificial Sequence: Synthetic oligonucleotide
  Description of Combined DNA/RNA Molecule: Synthetic oligonucleotide
uuuuuauuuauuuauuuuuggcuag

SEQ ID NO: 664 - DNA, 25 bp, Artificial Sequence
  Description of Artificial Sequence: Synthetic oligonucleotide
  Description of Combined DNA/RNA Molecule: Synthetic oligonucleotide
uuuauuuauuuauuuuuggcuaggg

SEQ ID NO: 665 - DNA, 25 bp, Artificial Sequence
  Description of Artificial Sequence: Synthetic oligonucleotide
  Description of Combined DNA/RNA Molecule: Synthetic oligonucleotide
uuuucgaauuauuuuuaagaagatg

SEQ ID NO: 666 - DNA, 25 bp, Artificial Sequence
  Description of Artificial Sequence: Synthetic oligonucleotide
  Description of Combined DNA/RNA Molecule: Synthetic oligonucleotide
caauauaauuuuuguaagaaggcag

SEQ ID NO: 667 - DNA, 25 bp, Artificial Sequence
  Description of Artificial Sequence: Synthetic oligonucleotide
  Description of Combined DNA/RNA Molecule: Synthetic oligonucleotide
caucaugaucauaggcaguugaaaa

SEQ ID NO: 668 - DNA, 25 bp, Artificial Sequence
  Description of Artificial Sequence: Synthetic oligonucleotide
  Description of Combined DNA/RNA Molecule: Synthetic oligonucleotide
ucaugaucauaggcaguugaaaaat

SEQ ID NO: 669 - DNA, 25 bp, Artificial Sequence
  Description of Artificial Sequence: Synthetic oligonucleotide
  Description of Combined DNA/RNA Molecule: Synthetic oligonucleotide
augaucauaggcaguugaaaaautt

SEQ ID NO: 670 - DNA, 25 bp, Artificial Sequence
  Description of Artificial Sequence: Synthetic oligonucleotide
  Description of Combined DNA/RNA Molecule: Synthetic oligonucleotide
gaucauaggcaguugaaaaauuutt

SEQ ID NO: 671 - DNA, 25 bp, Artificial Sequence
  Description of Artificial Sequence: Synthetic oligonucleotide
  Description of Combined DNA/RNA Molecule: Synthetic oligonucleotide
uugaaaaauuuuuacaccuuuuutt

SEQ ID NO: 672 - DNA, 25 bp, Artificial Sequence
  Description of Artificial Sequence: Synthetic oligonucleotide
  Description of Combined DNA/RNA Molecule: Synthetic oligonucleotide
uuuuuuuucacauuuuacauaaata

SEQ ID NO: 673 - DNA, 25 bp, Artificial Sequence
  Description of Artificial Sequence: Synthetic oligonucleotide
  Description of Combined DNA/RNA Molecule: Synthetic oligonucleotide
gguagccacaauugcacaauauatt

SEQ ID NO: 674 - DNA, 25 bp, Artificial Sequence
  Description of Artificial Sequence: Synthetic oligonucleotide
  Description of Combined DNA/RNA Molecule: Synthetic oligonucleotide
uagccacaauugcacaauauauutt

SEQ ID NO: 675 - DNA, 25 bp, Artificial Sequence
  Description of Artificial Sequence: Synthetic oligonucleotide
  Description of Combined DNA/RNA Molecule: Synthetic oligonucleotide
gccacaauugcacaauauauuuuct

SEQ ID NO: 676 - DNA, 25 bp, Artificial Sequence
  Description of Artificial Sequence: Synthetic oligonucleotide
  Description of Combined DNA/RNA Molecule: Synthetic oligonucleotide
cacaauugcacaauauauuuucuta

SEQ ID NO: 677 - DNA, 25 bp, Artificial Sequence
  Description of Artificial Sequence: Synthetic oligonucleotide
  Description of Combined DNA/RNA Molecule: Synthetic oligonucleotide
caauugcacaauauauuuucuuaaa

SEQ ID NO: 678 - DNA, 25 bp, Artificial Sequence
  Description of Artificial Sequence: Synthetic oligonucleotide
  Description of Combined DNA/RNA Molecule: Synthetic oligonucleotide
auugcacaauauauuuucuuaaaaa

SEQ ID NO: 679 - DNA, 25 bp, Artificial Sequence
  Description of Artificial Sequence: Synthetic oligonucleotide
  Description of Combined DNA/RNA Molecule: Synthetic oligonucleotide
caauauauuuucuuaaaaaauacca

SEQ ID NO: 680 - DNA, 25 bp, Artificial Sequence
  Description of Artificial Sequence: Synthetic oligonucleotide
  Description of Combined DNA/RNA Molecule: Synthetic oligonucleotide
guuuauaaaacuaguuuuuaagaag

SEQ ID NO: 681 - DNA, 25 bp, Artificial Sequence
  Description of Artificial Sequence: Synthetic oligonucleotide
  Description of Combined DNA/RNA Molecule: Synthetic oligonucleotide
uuuauaaaacuaguuuuuaagaaga

SEQ ID NO: 682 - DNA, 25 bp, Artificial Sequence
  Description of Artificial Sequence: Synthetic oligonucleotide
  Description of Combined DNA/RNA Molecule: Synthetic oligonucleotide
uauaaaacuaguuuuuaagaagaaa

SEQ ID NO: 683 - DNA, 25 bp, Artificial Sequence
  Description of Artificial Sequence: Synthetic oligonucleotide
  Description of Combined DNA/RNA Molecule: Synthetic oligonucleotide
uaaaacuaguuuuuaagaagaaatt

SEQ ID NO: 684 - DNA, 25 bp, Artificial Sequence
  Description of Artificial Sequence: Synthetic oligonucleotide
  Description of Combined DNA/RNA Molecule: Synthetic oligonucleotide
uuaagaagaaauuuuuuuuggccta

SEQ ID NO: 685 - DNA, 25 bp, Artificial Sequence
  Description of Artificial Sequence: Synthetic oligonucleotide
  Description of Combined DNA/RNA Molecule: Synthetic oligonucleotide
agaaauuuuuuuuggccuaugaaat

SEQ ID NO: 686 - DNA, 25 bp, Artificial Sequence
  Description of Artificial Sequence: Synthetic oligonucleotide
  Description of Combined DNA/RNA Molecule: Synthetic oligonucleotide
aaauuuuuuuuggccuaugaaautg

SEQ ID NO: 687 - DNA, 25 bp, Artificial Sequence
  Description of Artificial Sequence: Synthetic oligonucleotide
  Description of Combined DNA/RNA Molecule: Synthetic oligonucleotide
uaugaaauuguuaaaccuggaacat

SEQ ID NO: 688 - DNA, 25 bp, Artificial Sequence
  Description of Artificial Sequence: Synthetic oligonucleotide
  Description of Combined DNA/RNA Molecule: Synthetic oligonucleotide
auuguuaaucauauaauaaugautc

SEQ ID NO: 689 - DNA, 25 bp, Artificial Sequence
  Description of Artificial Sequence: Synthetic oligonucleotide
  Description of Combined DNA/RNA Molecule: Synthetic oligonucleotide
augguuuauuauuuaaauggguaaa

SEQ ID NO: 690 - DNA, 25 bp, Artificial Sequence
  Description of Artificial Sequence: Synthetic oligonucleotide
  Description of Combined DNA/RNA Molecule: Synthetic oligonucleotide
uggguaaagccauuuacauaauata

SEQ ID NO: 691 - DNA, 25 bp, Artificial Sequence
  Description of Artificial Sequence: Synthetic oligonucleotide
  Description of Combined DNA/RNA Molecule: Synthetic oligonucleotide
auuuacauaauauagaaagauaugc

SEQ ID NO: 692 - DNA, 25 bp, Artificial Sequence
  Description of Artificial Sequence: Synthetic oligonucleotide
  Description of Combined DNA/RNA Molecule: Synthetic oligonucleotide
aagguauguggcauuuauuuggata

SEQ ID NO: 693 - DNA, 25 bp, Artificial Sequence
  Description of Artificial Sequence: Synthetic oligonucleotide
  Description of Combined DNA/RNA Molecule: Synthetic oligonucleotide
gguauguggcauuuauuuggauaaa

SEQ ID NO: 694 - DNA, 25 bp, Artificial Sequence
  Description of Artificial Sequence: Synthetic oligonucleotide
  Description of Combined DNA/RNA Molecule: Synthetic oligonucleotide
uauguggcauuuauuuggauaaaat

SEQ ID NO: 695 - DNA, 25 bp, Artificial Sequence
  Description of Artificial Sequence: Synthetic oligonucleotide
  Description of Combined DNA/RNA Molecule: Synthetic oligonucleotide
uguggcauuuauuuggauaaaautc

SEQ ID NO: 696 - DNA, 25 bp, Artificial Sequence
  Description of Artificial Sequence: Synthetic oligonucleotide
  Description of Combined DNA/RNA Molecule: Synthetic oligonucleotide
uggcauuuauuuggauaaaauuctc

SEQ ID NO: 697 - DNA, 25 bp, Artificial Sequence
  Description of Artificial Sequence: Synthetic oligonucleotide
  Description of Combined DNA/RNA Molecule: Synthetic oligonucleotide
gcauuuauuuggauaaaauucucaa

SEQ ID NO: 698 - DNA, 25 bp, Artificial Sequence
  Description of Artificial Sequence: Synthetic oligonucleotide
  Description of Combined DNA/RNA Molecule: Synthetic oligonucleotide
auuuauuuggauaaaauucucaatt

SEQ ID NO: 699 - DNA, 25 bp, Artificial Sequence
  Description of Artificial Sequence: Synthetic oligonucleotide
  Description of Combined DNA/RNA Molecule: Synthetic oligonucleotide
uuauuuggauaaaauucucaauuca

SEQ ID NO: 700 - DNA, 25 bp, Artificial Sequence
  Description of Artificial Sequence: Synthetic oligonucleotide
  Description of Combined DNA/RNA Molecule: Synthetic oligonucleotide
auuuggauaaaauucucaauucaga

SEQ ID NO: 701 - DNA, 25 bp, Artificial Sequence
  Description of Artificial Sequence: Synthetic oligonucleotide
  Description of Combined DNA/RNA Molecule: Synthetic oligonucleotide
auuuggauaaaauucucaauucaga

SEQ ID NO: 702 - DNA, 25 bp, Artificial Sequence
  Description of Artificial Sequence: Synthetic oligonucleotide
  Description of Combined DNA/RNA Molecule: Synthetic oligonucleotide
uuggauaaaauucucaauucagaga

SEQ ID NO: 703 - DNA, 25 bp, Artificial Sequence
  Description of Artificial Sequence: Synthetic oligonucleotide
  Description of Combined DNA/RNA Molecule: Synthetic oligonucleotide
ggauaaaauucucaauucagagaaa

SEQ ID NO: 704 - DNA, 25 bp, Artificial Sequence
  Description of Artificial Sequence: Synthetic oligonucleotide
  Description of Combined DNA/RNA Molecule: Synthetic oligonucleotide
auaaaauucucaauucagagaaatc

SEQ ID NO: 705 - DNA, 25 bp, Artificial Sequence
  Description of Artificial Sequence: Synthetic oligonucleotide
  Description of Combined DNA/RNA Molecule: Synthetic oligonucleotide
aaaauucucaauucagagaaaucat

SEQ ID NO: 706 - DNA, 25 bp, Artificial Sequence
  Description of Artificial Sequence: Synthetic oligonucleotide
  Description of Combined DNA/RNA Molecule: Synthetic oligonucleotide
ucugauguuucuauagucacuuugc

SEQ ID NO: 707 - DNA, 25 bp, Artificial Sequence
  Description of Artificial Sequence: Synthetic oligonucleotide
  Description of Combined DNA/RNA Molecule: Synthetic oligonucleotide
guuucuauagucacuuugccagctc

SEQ ID NO: 708 - DNA, 25 bp, Artificial Sequence
  Description of Artificial Sequence: Synthetic oligonucleotide
  Description of Combined DNA/RNA Molecule: Synthetic oligonucleotide
uauagucacuuugccagcucaaaag

SEQ ID NO: 709 - DNA, 25 bp, Artificial Sequence
  Description of Artificial Sequence: Synthetic oligonucleotide
  Description of Combined DNA/RNA Molecule: Synthetic oligonucleotide
caaaagaaaacaauacccuauguag

SEQ ID NO: 710 - DNA, 25 bp, Artificial Sequence
  Description of Artificial Sequence: Synthetic oligonucleotide
  Description of Combined DNA/RNA Molecule: Synthetic oligonucleotide
uucugccuacccuguugguauaaag

SEQ ID NO: 711 - DNA, 25 bp, Artificial Sequence
  Description of Artificial Sequence: Synthetic oligonucleotide
  Description of Combined DNA/RNA Molecule: Synthetic oligonucleotide
cugccuacccuguugguauaaagat

SEQ ID NO: 712 - DNA, 25 bp, Artificial Sequence
  Description of Artificial Sequence: Synthetic oligonucleotide
  Description of Combined DNA/RNA Molecule: Synthetic oligonucleotide
ugccuacccuguugguauaaagata

SEQ ID NO: 713 - DNA, 25 bp, Artificial Sequence
  Description of Artificial Sequence: Synthetic oligonucleotide
  Description of Combined DNA/RNA Molecule: Synthetic oligonucleotide
ccuacccuguugguauaaagauatt

SEQ ID NO: 714 - DNA, 25 bp, Artificial Sequence
  Description of Artificial Sequence: Synthetic oligonucleotide
  Description of Combined DNA/RNA Molecule: Synthetic oligonucleotide
cuacccuguugguauaaagauautt

SEQ ID NO: 715 - DNA, 25 bp, Artificial Sequence
  Description of Artificial Sequence: Synthetic oligonucleotide
  Description of Combined DNA/RNA Molecule: Synthetic oligonucleotide
cuguugguauaaagauauuuugagc

SEQ ID NO: 716 - DNA, 25 bp, Artificial Sequence
  Description of Artificial Sequence: Synthetic oligonucleotide
  Description of Combined DNA/RNA Molecule: Synthetic oligonucleotide
uugguauaaagauauuuugagcaga

SEQ ID NO: 717 - DNA, 25 bp, Artificial Sequence
  Description of Artificial Sequence: Synthetic oligonucleotide
  Description of Combined DNA/RNA Molecule: Synthetic oligonucleotide
agaaaaaaaaaaucaugcauucuta

SEQ ID NO: 718 - DNA, 25 bp, Artificial Sequence
  Description of Artificial Sequence: Synthetic oligonucleotide
  Description of Combined DNA/RNA Molecule: Synthetic oligonucleotide
uauguuaauuugcucaaaauacaat

SEQ ID NO: 719 - DNA, 25 bp, Artificial Sequence
  Description of Artificial Sequence: Synthetic oligonucleotide
  Description of Combined DNA/RNA Molecule: Synthetic oligonucleotide
uuuuaugcacuuugucgcuauuaac

SEQ ID NO: 720 - DNA, 25 bp, Artificial Sequence
  Description of Artificial Sequence: Synthetic oligonucleotide
  Description of Combined DNA/RNA Molecule: Synthetic oligonucleotide
uuaugcacuuugucgcuauuaacat

SEQ ID NO: 721 - DNA, 25 bp, Artificial Sequence
  Description of Artificial Sequence: Synthetic oligonucleotide
  Description of Combined DNA/RNA Molecule: Synthetic oligonucleotide
augcacuuugucgcuauuaacaucc

SEQ ID NO: 722 - DNA, 25 bp, Artificial Sequence
  Description of Artificial Sequence: Synthetic oligonucleotide
  Description of Combined DNA/RNA Molecule: Synthetic oligonucleotide
gcacuuugucgcuauuaacaucctt

SEQ ID NO: 723 - DNA, 25 bp, Artificial Sequence
  Description of Artificial Sequence: Synthetic oligonucleotide
  Description of Combined DNA/RNA Molecule: Synthetic oligonucleotide
acuuugucgcuauuaacauccuutt

SEQ ID NO: 724 - DNA, 25 bp, Artificial Sequence
  Description of Artificial Sequence: Synthetic oligonucleotide
  Description of Combined DNA/RNA Molecule: Synthetic oligonucleotide
uuugucgcuauuaacauccuuuutt

SEQ ID NO: 725 - DNA, 25 bp, Artificial Sequence
  Description of Artificial Sequence: Synthetic oligonucleotide
  Description of Combined DNA/RNA Molecule: Synthetic oligonucleotide
ugucgcuauuaacauccuuuuuutc

SEQ ID NO: 726 - DNA, 25 bp, Artificial Sequence
  Description of Artificial Sequence: Synthetic oligonucleotide
  Description of Combined DNA/RNA Molecule: Synthetic oligonucleotide
ucgcuauuaacauccuuuuuuucat

SEQ ID NO: 727 - DNA, 25 bp, Artificial Sequence
  Description of Artificial Sequence: Synthetic oligonucleotide
  Description of Combined DNA/RNA Molecule: Synthetic oligonucleotide
gcuauuaacauccuuuuuuucaugt

SEQ ID NO: 728 - DNA, 25 bp, Artificial Sequence
  Description of Artificial Sequence: Synthetic oligonucleotide
  Description of Combined DNA/RNA Molecule: Synthetic oligonucleotide
auuaacauccuuuuuuucauguaga

SEQ ID NO: 729 - DNA, 25 bp, Artificial Sequence
  Description of Artificial Sequence: Synthetic oligonucleotide
  Description of Combined DNA/RNA Molecule: Synthetic oligonucleotide
gaguaauuuuagaagcauuauuuta

SEQ ID NO: 730 - DNA, 25 bp, Artificial Sequence
  Description of Artificial Sequence: Synthetic oligonucleotide
  Description of Combined DNA/RNA Molecule: Synthetic oligonucleotide
guaauuuuagaagcauuauuuuagg

SEQ ID NO: 731 - DNA, 25 bp, Artificial Sequence
  Description of Artificial Sequence: Synthetic oligonucleotide
  Description of Combined DNA/RNA Molecule: Synthetic oligonucleotide
aauuuuagaagcauuauuuuaggaa

SEQ ID NO: 732 - DNA, 25 bp, Artificial Sequence
  Description of Artificial Sequence: Synthetic oligonucleotide
  Description of Combined DNA/RNA Molecule: Synthetic oligonucleotide
uuuuagaagcauuauuuuaggaata

SEQ ID NO: 733 - DNA, 25 bp, Artificial Sequence
  Description of Artificial Sequence: Synthetic oligonucleotide
  Description of Combined DNA/RNA Molecule: Synthetic oligonucleotide
uuagaagcauuauuuuaggaauata

SEQ ID NO: 734 - DNA, 25 bp, Artificial Sequence
  Description of Artificial Sequence: Synthetic oligonucleotide
  Description of Combined DNA/RNA Molecule: Synthetic oligonucleotide
agaagcauuauuuuaggaauauata

SEQ ID NO: 735 - DNA, 25 bp, Artificial Sequence
  Description of Artificial Sequence: Synthetic oligonucleotide
  Description of Combined DNA/RNA Molecule: Synthetic oligonucleotide
aagcauuauuuuaggaauauauagt

SEQ ID NO: 736 - DNA, 25 bp, Artificial Sequence
  Description of Artificial Sequence: Synthetic oligonucleotide
  Description of Combined DNA/RNA Molecule: Synthetic oligonucleotide
gcauuauuuuaggaauauauagutg

SEQ ID NO: 737 - DNA, 25 bp, Artificial Sequence
  Description of Artificial Sequence: Synthetic oligonucleotide
  Description of Combined DNA/RNA Molecule: Synthetic oligonucleotide
uaaauaucuuguuuuuucuauguac

SEQ ID NO: 738 - DNA, 25 bp, Artificial Sequence
  Description of Artificial Sequence: Synthetic oligonucleotide
  Description of Combined DNA/RNA Molecule: Synthetic oligonucleotide
auguacauuguacaaauuuuucatt

SEQ ID NO: 739 - DNA, 25 bp, Artificial Sequence
  Description of Artificial Sequence: Synthetic oligonucleotide
  Description of Combined DNA/RNA Molecule: Synthetic oligonucleotide
uucauuccuuuugcucuuuguggtt

SEQ ID NO: 740 - DNA, 25 bp, Artificial Sequence
  Description of Artificial Sequence: Synthetic oligonucleotide
  Description of Combined DNA/RNA Molecule: Synthetic oligonucleotide
ucauuccuuuugcucuuuguggutg

SEQ ID NO: 741 - DNA, 25 bp, Artificial Sequence
  Description of Artificial Sequence: Synthetic oligonucleotide
  Description of Combined DNA/RNA Molecule: Synthetic oligonucleotide
cauuccuuuugcucuuugugguugg

SEQ ID NO: 742 - DNA, 25 bp, Artificial Sequence
  Description of Artificial Sequence: Synthetic oligonucleotide
  Description of Combined DNA/RNA Molecule: Synthetic oligonucleotide
uuccuuuugcucuuugugguuggat

SEQ ID NO: 743 - DNA, 25 bp, Artificial Sequence
  Description of Artificial Sequence: Synthetic oligonucleotide
  Description of Combined DNA/RNA Molecule: Synthetic oligonucleotide
uccuuuugcucuuugugguuggatc

SEQ ID NO: 744 - DNA, 25 bp, Artificial Sequence
  Description of Artificial Sequence: Synthetic oligonucleotide
  Description of Combined DNA/RNA Molecule: Synthetic oligonucleotide
ccuuuugcucuuugugguuggauct

SEQ ID NO: 745 - DNA, 25 bp, Artificial Sequence
  Description of Artificial Sequence: Synthetic oligonucleotide
  Description of Combined DNA/RNA Molecule: Synthetic oligonucleotide
cuuuugcucuuugugguuggaucta

SEQ ID NO: 746 - DNA, 25 bp, Artificial Sequence
  Description of Artificial Sequence: Synthetic oligonucleotide
  Description of Combined DNA/RNA Molecule: Synthetic oligonucleotide
uuuugcucuuugugguuggaucuaa

SEQ ID NO: 747 - DNA, 25 bp, Artificial Sequence
  Description of Artificial Sequence: Synthetic oligonucleotide
  Description of Combined DNA/RNA Molecule: Synthetic oligonucleotide
uuugcucuuugugguuggaucuaac

SEQ ID NO: 748 - DNA, 25 bp, Artificial Sequence
  Description of Artificial Sequence: Synthetic oligonucleotide
  Description of Combined DNA/RNA Molecule: Synthetic oligonucleotide
uugcucuuugugguuggaucuaaca

SEQ ID NO: 749 - DNA, 25 bp, Artificial Sequence
  Description of Artificial Sequence: Synthetic oligonucleotide
  Description of Combined DNA/RNA Molecule: Synthetic oligonucleotide
ugcucuuugugguuggaucuaacac

SEQ ID NO: 750 - DNA, 25 bp, Artificial Sequence
  Description of Artificial Sequence: Synthetic oligonucleotide
  Description of Combined DNA/RNA Molecule: Synthetic oligonucleotide
cucuuugugguuggaucuaacacta

SEQ ID NO: 751 - DNA, 25 bp, Artificial Sequence
  Description of Artificial Sequence: Synthetic oligonucleotide
  Description of Combined DNA/RNA Molecule: Synthetic oligonucleotide
aucaaauaaacaucuucuguggacc

SEQ ID NO: 752 - DNA, 25 bp, Artificial Sequence
  Description of Artificial Sequence: Synthetic oligonucleotide
  Description of Combined DNA/RNA Molecule: Synthetic oligonucleotide
caaauaaacaucuucuguggaccag

SEQ ID NO: 753 - DNA, 25 bp, Artificial Sequence
  Description of Artificial Sequence: Synthetic oligonucleotide
  Description of Combined DNA/RNA Molecule: Synthetic oligonucleotide
aauaaacaucuucuguggaccaggc

SEQ ID NO: 754 - DNA, 25 bp, Artificial Sequence
  Description of Artificial Sequence: Synthetic oligonucleotide
  Description of Combined DNA/RNA Molecule: Synthetic oligonucleotide
uaaacaucuucuguggaccaggcaa

SEQ ID NO: 755 - DNA, 25 bp, Artificial Sequence
  Description of Artificial Sequence: Synthetic oligonucleotide
  Description of Combined DNA/RNA Molecule: Synthetic oligonucleotide
aacaucuucuguggaccaggcaaaa

SEQ ID NO: 756 - DNA, 25 bp, Artificial Sequence
  Description of Artificial Sequence: Synthetic oligonucleotide
  Description of Combined DNA/RNA Molecule: Synthetic oligonucleotide
caucuucuguggaccaggcaaaaaa

SEQ ID NO: 757 - DNA, 27 bp, Artificial Sequence
  Description of Artificial Sequence: Synthetic oligonucleotide
  Description of Combined DNA/RNA Molecule: Synthetic oligonucleotide
ccgcgcgcccgagcgcgcctccgccct

SEQ ID NO: 758 - DNA, 27 bp, Artificial Sequence
  Description of Artificial Sequence: Synthetic oligonucleotide
  Description of Combined DNA/RNA Molecule: Synthetic oligonucleotide
gcgcgcccgagcgcgcctccgcccttg

SEQ ID NO: 759 - DNA, 27 bp, Artificial Sequence
  Description of Artificial Sequence: Synthetic oligonucleotide
  Description of Combined DNA/RNA Molecule: Synthetic oligonucleotide
gcgcccgagcgcgcctccgcccttgcc

SEQ ID NO: 760 - DNA, 27 bp, Artificial Sequence
  Description of Artificial Sequence: Synthetic oligonucleotide
  Description of Combined DNA/RNA Molecule: Synthetic oligonucleotide
gcccgagcgcgcctccgcccttgcccg

SEQ ID NO: 761 - DNA, 27 bp, Artificial Sequence
  Description of Artificial Sequence: Synthetic oligonucleotide
  Description of Combined DNA/RNA Molecule: Synthetic oligonucleotide
ccgagcgcgcctccgcccttgcccgcc

SEQ ID NO: 762 - DNA, 27 bp, Artificial Sequence
  Description of Artificial Sequence: Synthetic oligonucleotide
  Description of Combined DNA/RNA Molecule: Synthetic oligonucleotide
gctgcctcagctcctcagtgcacagtg

SEQ ID NO: 763 - DNA, 27 bp, Artificial Sequence
  Description of Artificial Sequence: Synthetic oligonucleotide
  Description of Combined DNA/RNA Molecule: Synthetic oligonucleotide
ctgcctcagctcctcagtgcacagtgc

SEQ ID NO: 764 - DNA, 27 bp, Artificial Sequence
  Description of Artificial Sequence: Synthetic oligonucleotide
  Description of Combined DNA/RNA Molecule: Synthetic oligonucleotide
gcctcagctcctcagtgcacagtgctg

SEQ ID NO: 765 - DNA, 27 bp, Artificial Sequence
  Description of Artificial Sequence: Synthetic oligonucleotide
  Description of Combined DNA/RNA Molecule: Synthetic oligonucleotide
cagctcctcagtgcacagtgctgcctc

SEQ ID NO: 766 - DNA, 27 bp, Artificial Sequence
  Description of Artificial Sequence: Synthetic oligonucleotide
  Description of Combined DNA/RNA Molecule: Synthetic oligonucleotide
agctcctcagtgcacagtgctgcctcg

SEQ ID NO: 767 - DNA, 27 bp, Artificial Sequence
  Description of Artificial Sequence: Synthetic oligonucleotide
  Description of Combined DNA/RNA Molecule: Synthetic oligonucleotide
gtgctgcctcgtctgaggggacaggag

SEQ ID NO: 768 - DNA, 27 bp, Artificial Sequence
  Description of Artificial Sequence: Synthetic oligonucleotide
  Description of Combined DNA/RNA Molecule: Synthetic oligonucleotide
gattgccgcccgcttctctctagtctc

SEQ ID NO: 769 - DNA, 27 bp, Artificial Sequence
  Description of Artificial Sequence: Synthetic oligonucleotide
  Description of Combined DNA/RNA Molecule: Synthetic oligonucleotide
ttgccgcccgcttctctctagtctcac

SEQ ID NO: 770 - DNA, 27 bp, Artificial Sequence
  Description of Artificial Sequence: Synthetic oligonucleotide
  Description of Combined DNA/RNA Molecule: Synthetic oligonucleotide
tgccgcccgcttctctctagtctcacg

SEQ ID NO: 771 - DNA, 27 bp, Artificial Sequence
  Description of Artificial Sequence: Synthetic oligonucleotide
  Description of Combined DNA/RNA Molecule: Synthetic oligonucleotide
acgaggggtttcccgcctcgcaccccc

SEQ ID NO: 772 - DNA, 27 bp, Artificial Sequence
  Description of Artificial Sequence: Synthetic oligonucleotide
  Description of Combined DNA/RNA Molecule: Synthetic oligonucleotide
acctctggacttgcctttccttctctt

SEQ ID NO: 773 - DNA, 27 bp, Artificial Sequence
  Description of Artificial Sequence: Synthetic oligonucleotide
  Description of Combined DNA/RNA Molecule: Synthetic oligonucleotide
tctggacttgcctttccttctcttctc

SEQ ID NO: 774 - DNA, 27 bp, Artificial Sequence
  Description of Artificial Sequence: Synthetic oligonucleotide
  Description of Combined DNA/RNA Molecule: Synthetic oligonucleotide
tggacttgcctttccttctcttctccg

SEQ ID NO: 775 - DNA, 27 bp, Artificial Sequence
  Description of Artificial Sequence: Synthetic oligonucleotide
  Description of Combined DNA/RNA Molecule: Synthetic oligonucleotide
acttgcctttccttctcttctccgcgt

SEQ ID NO: 776 - DNA, 27 bp, Artificial Sequence
  Description of Artificial Sequence: Synthetic oligonucleotide
  Description of Combined DNA/RNA Molecule: Synthetic oligonucleotide
ttgcctttccttctcttctccgcgtgt

SEQ ID NO: 777 - DNA, 27 bp, Artificial Sequence
  Description of Artificial Sequence: Synthetic oligonucleotide
  Description of Combined DNA/RNA Molecule: Synthetic oligonucleotide
tgcctttccttctcttctccgcgtgtg

SEQ ID NO: 778 - DNA, 27 bp, Artificial Sequence
  Description of Artificial Sequence: Synthetic oligonucleotide
  Description of Combined DNA/RNA Molecule: Synthetic oligonucleotide
gcctttccttctcttctccgcgtgtgg

SEQ ID NO: 779 - DNA, 27 bp, Artificial Sequence
  Description of Artificial Sequence: Synthetic oligonucleotide
  Description of Combined DNA/RNA Molecule: Synthetic oligonucleotide
tcttctccgcgtgtggagggagccagc

SEQ ID NO: 780 - DNA, 27 bp, Artificial Sequence
  Description of Artificial Sequence: Synthetic oligonucleotide
  Description of Combined DNA/RNA Molecule: Synthetic oligonucleotide
ttctccgcgtgtggagggagccagcgc

SEQ ID NO: 781 - DNA, 27 bp, Artificial Sequence
  Description of Artificial Sequence: Synthetic oligonucleotide
  Description of Combined DNA/RNA Molecule: Synthetic oligonucleotide
ctccgcgtgtggagggagccagcgctt

SEQ ID NO: 782 - DNA, 27 bp, Artificial Sequence
  Description of Artificial Sequence: Synthetic oligonucleotide
  Description of Combined DNA/RNA Molecule: Synthetic oligonucleotide
gggagccagcgcttaggccggagcgag

SEQ ID NO: 783 - DNA, 27 bp, Artificial Sequence
  Description of Artificial Sequence: Synthetic oligonucleotide
  Description of Combined DNA/RNA Molecule: Synthetic oligonucleotide
gtgaagacatcgcggggaccgattcac

SEQ ID NO: 784 - DNA, 27 bp, Artificial Sequence
  Description of Artificial Sequence: Synthetic oligonucleotide
  Description of Combined DNA/RNA Molecule: Synthetic oligonucleotide
cgattcaccatggagggcgccggcggc

SEQ ID NO: 785 - DNA, 27 bp, Artificial Sequence
  Description of Artificial Sequence: Synthetic oligonucleotide
  Description of Combined DNA/RNA Molecule: Synthetic oligonucleotide
caccatggagggcgccggcggcgcgaa

SEQ ID NO: 786 - DNA, 27 bp, Artificial Sequence
  Description of Artificial Sequence: Synthetic oligonucleotide
  Description of Combined DNA/RNA Molecule: Synthetic oligonucleotide
ccatggagggcgccggcggcgcgaacg

SEQ ID NO: 787 - DNA, 27 bp, Artificial Sequence
  Description of Artificial Sequence: Synthetic oligonucleotide
  Description of Combined DNA/RNA Molecule: Synthetic oligonucleotide
cgcgaacgacaagaaaaagataagttc

SEQ ID NO: 788 - DNA, 27 bp, Artificial Sequence
  Description of Artificial Sequence: Synthetic oligonucleotide
  Description of Combined DNA/RNA Molecule: Synthetic oligonucleotide
gacaagaaaaagataagttctgaacgt

SEQ ID NO: 789 - DNA, 27 bp, Artificial Sequence
  Description of Artificial Sequence: Synthetic oligonucleotide
  Description of Combined DNA/RNA Molecule: Synthetic oligonucleotide
aagttctgaacgtcgaaaagaaaagtc

SEQ ID NO: 790 - DNA, 27 bp, Artificial Sequence
  Description of Artificial Sequence: Synthetic oligonucleotide
  Description of Combined DNA/RNA Molecule: Synthetic oligonucleotide
gttctgaacgtcgaaaagaaaagtctc

SEQ ID NO: 791 - DNA, 27 bp, Artificial Sequence
  Description of Artificial Sequence: Synthetic oligonucleotide
  Description of Combined DNA/RNA Molecule: Synthetic oligonucleotide
tctgaacgtcgaaaagaaaagtctcga

SEQ ID NO: 792 - DNA, 27 bp, Artificial Sequence
  Description of Artificial Sequence: Synthetic oligonucleotide
  Description of Combined DNA/RNA Molecule: Synthetic oligonucleotide
tgaacgtcgaaaagaaaagtctcgaga

SEQ ID NO: 793 - DNA, 27 bp, Artificial Sequence
  Description of Artificial Sequence: Synthetic oligonucleotide
  Description of Combined DNA/RNA Molecule: Synthetic oligonucleotide
aagaatctgaagttttttatgagcttg

SEQ ID NO: 794 - DNA, 27 bp, Artificial Sequence
  Description of Artificial Sequence: Synthetic oligonucleotide
  Description of Combined DNA/RNA Molecule: Synthetic oligonucleotide
aatctgaagttttttatgagcttgctc

SEQ ID NO: 795 - DNA, 27 bp, Artificial Sequence
  Description of Artificial Sequence: Synthetic oligonucleotide
  Description of Combined DNA/RNA Molecule: Synthetic oligonucleotide
tctgaagttttttatgagcttgctcat

SEQ ID NO: 796 - DNA, 27 bp, Artificial Sequence
  Description of Artificial Sequence: Synthetic oligonucleotide
  Description of Combined DNA/RNA Molecule: Synthetic oligonucleotide
tgaagttttttatgagcttgctcatca

SEQ ID NO: 797 - DNA, 27 bp, Artificial Sequence
  Description of Artificial Sequence: Synthetic oligonucleotide
  Description of Combined DNA/RNA Molecule: Synthetic oligonucleotide
aagttttttatgagcttgctcatcagt

SEQ ID NO: 798 - DNA, 27 bp, Artificial Sequence
  Description of Artificial Sequence: Synthetic oligonucleotide
  Description of Combined DNA/RNA Molecule: Synthetic oligonucleotide
gttttttatgagcttgctcatcagttg

SEQ ID NO: 799 - DNA, 27 bp, Artificial Sequence
  Description of Artificial Sequence: Synthetic oligonucleotide
  Description of Combined DNA/RNA Molecule: Synthetic oligonucleotide
tttttatgagcttgctcatcagttgcc

SEQ ID NO: 800 - DNA, 27 bp, Artificial Sequence
  Description of Artificial Sequence: Synthetic oligonucleotide
  Description of Combined DNA/RNA Molecule: Synthetic oligonucleotide
tttatgagcttgctcatcagttgccac

SEQ ID NO: 801 - DNA, 27 bp, Artificial Sequence
  Description of Artificial Sequence: Synthetic oligonucleotide
  Description of Combined DNA/RNA Molecule: Synthetic oligonucleotide
tatgagcttgctcatcagttgccactt

SEQ ID NO: 802 - DNA, 27 bp, Artificial Sequence
  Description of Artificial Sequence: Synthetic oligonucleotide
  Description of Combined DNA/RNA Molecule: Synthetic oligonucleotide
tgagcttgctcatcagttgccacttcc

SEQ ID NO: 803 - DNA, 27 bp, Artificial Sequence
  Description of Artificial Sequence: Synthetic oligonucleotide
  Description of Combined DNA/RNA Molecule: Synthetic oligonucleotide
agcttgctcatcagttgccacttccac

SEQ ID NO: 804 - DNA, 27 bp, Artificial Sequence
  Description of Artificial Sequence: Synthetic oligonucleotide
  Description of Combined DNA/RNA Molecule: Synthetic oligonucleotide
cttgctcatcagttgccacttccacat

SEQ ID NO: 805 - DNA, 27 bp, Artificial Sequence
  Description of Artificial Sequence: Synthetic oligonucleotide
  Description of Combined DNA/RNA Molecule: Synthetic oligonucleotide
tgctcatcagttgccacttccacataa

SEQ ID NO: 806 - DNA, 27 bp, Artificial Sequence
  Description of Artificial Sequence: Synthetic oligonucleotide
  Description of Combined DNA/RNA Molecule: Synthetic oligonucleotide
gccacttccacataatgtgagttcgca

SEQ ID NO: 807 - DNA, 27 bp, Artificial Sequence
  Description of Artificial Sequence: Synthetic oligonucleotide
  Description of Combined DNA/RNA Molecule: Synthetic oligonucleotide
aacttctggatgctggtgatttggata

SEQ ID NO: 808 - DNA, 27 bp, Artificial Sequence
  Description of Artificial Sequence: Synthetic oligonucleotide
  Description of Combined DNA/RNA Molecule: Synthetic oligonucleotide
cttctggatgctggtgatttggatatt

SEQ ID NO: 809 - DNA, 27 bp, Artificial Sequence
  Description of Artificial Sequence: Synthetic oligonucleotide
  Description of Combined DNA/RNA Molecule: Synthetic oligonucleotide
ttctggatgctggtgatttggatattg

SEQ ID NO: 810 - DNA, 27 bp, Artificial Sequence
  Description of Artificial Sequence: Synthetic oligonucleotide
  Description of Combined DNA/RNA Molecule: Synthetic oligonucleotide
gatattgaagatgacatgaaagcacag

SEQ ID NO: 811 - DNA, 27 bp, Artificial Sequence
  Description of Artificial Sequence: Synthetic oligonucleotide
  Description of Combined DNA/RNA Molecule: Synthetic oligonucleotide
gatgaattgcttttatttgaaagcctt

SEQ ID NO: 812 - DNA, 27 bp, Artificial Sequence
  Description of Artificial Sequence: Synthetic oligonucleotide
  Description of Combined DNA/RNA Molecule: Synthetic oligonucleotide
ttgaaagccttggatggttttgttatg

SEQ ID NO: 813 - DNA, 27 bp, Artificial Sequence
  Description of Artificial Sequence: Synthetic oligonucleotide
  Description of Combined DNA/RNA Molecule: Synthetic oligonucleotide
aagccttggatggttttgttatggttc

SEQ ID NO: 814 - DNA, 27 bp, Artificial Sequence
  Description of Artificial Sequence: Synthetic oligonucleotide
  Description of Combined DNA/RNA Molecule: Synthetic oligonucleotide
gccttggatggttttgttatggttctc

SEQ ID NO: 815 - DNA, 27 bp, Artificial Sequence
  Description of Artificial Sequence: Synthetic oligonucleotide
  Description of Combined DNA/RNA Molecule: Synthetic oligonucleotide
cttggatggttttgttatggttctcac

SEQ ID NO: 816 - DNA, 27 bp, Artificial Sequence
  Description of Artificial Sequence: Synthetic oligonucleotide
  Description of Combined DNA/RNA Molecule: Synthetic oligonucleotide
tggatggttttgttatggttctcacag

SEQ ID NO: 817 - DNA, 27 bp, Artificial Sequence
  Description of Artificial Sequence: Synthetic oligonucleotide
  Description of Combined DNA/RNA Molecule: Synthetic oligonucleotide
tgatttacatttctgataatgtgaaca

SEQ ID NO: 818 - DNA, 27 bp, Artificial Sequence
  Description of Artificial Sequence: Synthetic oligonucleotide
  Description of Combined DNA/RNA Molecule: Synthetic oligonucleotide
gggattaactcagtttgaactaactgg

SEQ ID NO: 819 - DNA, 27 bp, Artificial Sequence
  Description of Artificial Sequence: Synthetic oligonucleotide
  Description of Combined DNA/RNA Molecule: Synthetic oligonucleotide
attaactcagtttgaactaactggaca

SEQ ID NO: 820 - DNA, 27 bp, Artificial Sequence
  Description of Artificial Sequence: Synthetic oligonucleotide
  Description of Combined DNA/RNA Molecule: Synthetic oligonucleotide
gtgtttgattttactcatccatgtgac

SEQ ID NO: 821 - DNA, 27 bp, Artificial Sequence
  Description of Artificial Sequence: Synthetic oligonucleotide
  Description of Combined DNA/RNA Molecule: Synthetic oligonucleotide
gtttgattttactcatccatgtgacca

SEQ ID NO: 822 - DNA, 27 bp, Artificial Sequence
  Description of Artificial Sequence: Synthetic oligonucleotide
  Description of Combined DNA/RNA Molecule: Synthetic oligonucleotide
ttgattttactcatccatgtgaccatg

SEQ ID NO: 823 - DNA, 27 bp, Artificial Sequence
  Description of Artificial Sequence: Synthetic oligonucleotide
  Description of Combined DNA/RNA Molecule: Synthetic oligonucleotide
gattttactcatccatgtgaccatgag

SEQ ID NO: 824 - DNA, 27 bp, Artificial Sequence
  Description of Artificial Sequence: Synthetic oligonucleotide
  Description of Combined DNA/RNA Molecule: Synthetic oligonucleotide
ttttactcatccatgtgaccatgagga

SEQ ID NO: 825 - DNA, 27 bp, Artificial Sequence
  Description of Artificial Sequence: Synthetic oligonucleotide
  Description of Combined DNA/RNA Molecule: Synthetic oligonucleotide
ttactcatccatgtgaccatgaggaaa

SEQ ID NO: 826 - DNA, 27 bp, Artificial Sequence
  Description of Artificial Sequence: Synthetic oligonucleotide
  Description of Combined DNA/RNA Molecule: Synthetic oligonucleotide
actcatccatgtgaccatgaggaaatg

SEQ ID NO: 827 - DNA, 27 bp, Artificial Sequence
  Description of Artificial Sequence: Synthetic oligonucleotide
  Description of Combined DNA/RNA Molecule: Synthetic oligonucleotide
tcatccatgtgaccatgaggaaatgag

SEQ ID NO: 828 - DNA, 27 bp, Artificial Sequence
  Description of Artificial Sequence: Synthetic oligonucleotide
  Description of Combined DNA/RNA Molecule: Synthetic oligonucleotide
atccatgtgaccatgaggaaatgagag

SEQ ID NO: 829 - DNA, 27 bp, Artificial Sequence
  Description of Artificial Sequence: Synthetic oligonucleotide
  Description of Combined DNA/RNA Molecule: Synthetic oligonucleotide
ccatgtgaccatgaggaaatgagagaa

SEQ ID NO: 830 - DNA, 27 bp, Artificial Sequence
  Description of Artificial Sequence: Synthetic oligonucleotide
  Description of Combined DNA/RNA Molecule: Synthetic oligonucleotide
atgtgaccatgaggaaatgagagaaat

SEQ ID NO: 831 - DNA, 27 bp, Artificial Sequence
  Description of Artificial Sequence: Synthetic oligonucleotide
  Description of Combined DNA/RNA Molecule: Synthetic oligonucleotide
gtgaccatgaggaaatgagagaaatgc

SEQ ID NO: 832 - DNA, 27 bp, Artificial Sequence
  Description of Artificial Sequence: Synthetic oligonucleotide
  Description of Combined DNA/RNA Molecule: Synthetic oligonucleotide
gaccatgaggaaatgagagaaatgctt

SEQ ID NO: 833 - DNA, 27 bp, Artificial Sequence
  Description of Artificial Sequence: Synthetic oligonucleotide
  Description of Combined DNA/RNA Molecule: Synthetic oligonucleotide
ccatgaggaaatgagagaaatgcttac

SEQ ID NO: 834 - DNA, 27 bp, Artificial Sequence
  Description of Artificial Sequence: Synthetic oligonucleotide
  Description of Combined DNA/RNA Molecule: Synthetic oligonucleotide
atgaggaaatgagagaaatgcttacac

SEQ ID NO: 835 - DNA, 27 bp, Artificial Sequence
  Description of Artificial Sequence: Synthetic oligonucleotide
  Description of Combined DNA/RNA Molecule: Synthetic oligonucleotide
agcgaagcttttttctcagaatgaagt

SEQ ID NO: 836 - DNA, 27 bp, Artificial Sequence
  Description of Artificial Sequence: Synthetic oligonucleotide
  Description of Combined DNA/RNA Molecule: Synthetic oligonucleotide
aagcttttttctcagaatgaagtgtac

SEQ ID NO: 837 - DNA, 27 bp, Artificial Sequence
  Description of Artificial Sequence: Synthetic oligonucleotide
  Description of Combined DNA/RNA Molecule: Synthetic oligonucleotide
gcttttttctcagaatgaagtgtaccc

SEQ ID NO: 838 - DNA, 27 bp, Artificial Sequence
  Description of Artificial Sequence: Synthetic oligonucleotide
  Description of Combined DNA/RNA Molecule: Synthetic oligonucleotide
tatatgataccaacagtaaccaacctc

SEQ ID NO: 839 - DNA, 27 bp, Artificial Sequence
  Description of Artificial Sequence: Synthetic oligonucleotide
  Description of Combined DNA/RNA Molecule: Synthetic oligonucleotide
tatgataccaacagtaaccaacctcag

SEQ ID NO: 840 - DNA, 27 bp, Artificial Sequence
  Description of Artificial Sequence: Synthetic oligonucleotide
  Description of Combined DNA/RNA Molecule: Synthetic oligonucleotide
tgataccaacagtaaccaacctcagtg

SEQ ID NO: 841 - DNA, 27 bp, Artificial Sequence
  Description of Artificial Sequence: Synthetic oligonucleotide
  Description of Combined DNA/RNA Molecule: Synthetic oligonucleotide
ataccaacagtaaccaacctcagtgtg

SEQ ID NO: 842 - DNA, 27 bp, Artificial Sequence
  Description of Artificial Sequence: Synthetic oligonucleotide
  Description of Combined DNA/RNA Molecule: Synthetic oligonucleotide
accaacagtaaccaacctcagtgtggg

SEQ ID NO: 843 - DNA, 27 bp, Artificial Sequence
  Description of Artificial Sequence: Synthetic oligonucleotide
  Description of Combined DNA/RNA Molecule: Synthetic oligonucleotide
caacagtaaccaacctcagtgtgggta

SEQ ID NO: 844 - DNA, 27 bp, Artificial Sequence
  Description of Artificial Sequence: Synthetic oligonucleotide
  Description of Combined DNA/RNA Molecule: Synthetic oligonucleotide
acagtaaccaacctcagtgtgggtata

SEQ ID NO: 845 - DNA, 27 bp, Artificial Sequence
  Description of Artificial Sequence: Synthetic oligonucleotide
  Description of Combined DNA/RNA Molecule: Synthetic oligonucleotide
agtaaccaacctcagtgtgggtataag

SEQ ID NO: 846 - DNA, 27 bp, Artificial Sequence
  Description of Artificial Sequence: Synthetic oligonucleotide
  Description of Combined DNA/RNA Molecule: Synthetic oligonucleotide
taaccaacctcagtgtgggtataagaa

SEQ ID NO: 847 - DNA, 27 bp, Artificial Sequence
  Description of Artificial Sequence: Synthetic oligonucleotide
  Description of Combined DNA/RNA Molecule: Synthetic oligonucleotide
cacctatgacctgcttggtgctgattt

SEQ ID NO: 848 - DNA, 27 bp, Artificial Sequence
  Description of Artificial Sequence: Synthetic oligonucleotide
  Description of Combined DNA/RNA Molecule: Synthetic oligonucleotide
acctatgacctgcttggtgctgatttg

SEQ ID NO: 849 - DNA, 27 bp, Artificial Sequence
  Description of Artificial Sequence: Synthetic oligonucleotide
  Description of Combined DNA/RNA Molecule: Synthetic oligonucleotide
ctatgacctgcttggtgctgatttgtg

SEQ ID NO: 850 - DNA, 27 bp, Artificial Sequence
  Description of Artificial Sequence: Synthetic oligonucleotide
  Description of Combined DNA/RNA Molecule: Synthetic oligonucleotide
ctgcttggtgctgatttgtgaacccat

SEQ ID NO: 851 - DNA, 27 bp, Artificial Sequence
  Description of Artificial Sequence: Synthetic oligonucleotide
  Description of Combined DNA/RNA Molecule: Synthetic oligonucleotide
gcttggtgctgatttgtgaacccattc

SEQ ID NO: 852 - DNA, 27 bp, Artificial Sequence
  Description of Artificial Sequence: Synthetic oligonucleotide
  Description of Combined DNA/RNA Molecule: Synthetic oligonucleotide
ttggtgctgatttgtgaacccattcct

SEQ ID NO: 853 - DNA, 27 bp, Artificial Sequence
  Description of Artificial Sequence: Synthetic oligonucleotide
  Description of Combined DNA/RNA Molecule: Synthetic oligonucleotide
ggtgctgatttgtgaacccattcctca

SEQ ID NO: 854 - DNA, 27 bp, Artificial Sequence
  Description of Artificial Sequence: Synthetic oligonucleotide
  Description of Combined DNA/RNA Molecule: Synthetic oligonucleotide
tgctgatttgtgaacccattcctcacc

SEQ ID NO: 855 - DNA, 27 bp, Artificial Sequence
  Description of Artificial Sequence: Synthetic oligonucleotide
  Description of Combined DNA/RNA Molecule: Synthetic oligonucleotide
ctgatttgtgaacccattcctcaccca

SEQ ID NO: 856 - DNA, 27 bp, Artificial Sequence
  Description of Artificial Sequence: Synthetic oligonucleotide
  Description of Combined DNA/RNA Molecule: Synthetic oligonucleotide
gatttgtgaacccattcctcacccatc

SEQ ID NO: 857 - DNA, 27 bp, Artificial Sequence
  Description of Artificial Sequence: Synthetic oligonucleotide
  Description of Combined DNA/RNA Molecule: Synthetic oligonucleotide
atcaaatattgaaattcctttagatag

SEQ ID NO: 858 - DNA, 27 bp, Artificial Sequence
  Description of Artificial Sequence: Synthetic oligonucleotide
  Description of Combined DNA/RNA Molecule: Synthetic oligonucleotide
caaatattgaaattcctttagatagca

SEQ ID NO: 859 - DNA, 27 bp, Artificial Sequence
  Description of Artificial Sequence: Synthetic oligonucleotide
  Description of Combined DNA/RNA Molecule: Synthetic oligonucleotide
aatattgaaattcctttagatagcaag

SEQ ID NO: 860 - DNA, 27 bp, Artificial Sequence
  Description of Artificial Sequence: Synthetic oligonucleotide
  Description of Combined DNA/RNA Molecule: Synthetic oligonucleotide
tattgaaattcctttagatagcaagac

SEQ ID NO: 861 - DNA, 27 bp, Artificial Sequence
  Description of Artificial Sequence: Synthetic oligonucleotide
  Description of Combined DNA/RNA Molecule: Synthetic oligonucleotide
ttgaaattcctttagatagcaagactt

SEQ ID NO: 862 - DNA, 27 bp, Artificial Sequence
  Description of Artificial Sequence: Synthetic oligonucleotide
  Description of Combined DNA/RNA Molecule: Synthetic oligonucleotide
gaaattcctttagatagcaagactttc

SEQ ID NO: 863 - DNA, 27 bp, Artificial Sequence
  Description of Artificial Sequence: Synthetic oligonucleotide
  Description of Combined DNA/RNA Molecule: Synthetic oligonucleotide
aattcctttagatagcaagactttcct

SEQ ID NO: 864 - DNA, 27 bp, Artificial Sequence
  Description of Artificial Sequence: Synthetic oligonucleotide
  Description of Combined DNA/RNA Molecule: Synthetic oligonucleotide
cacagcctggatatgaaattttcttat

SEQ ID NO: 865 - DNA, 27 bp, Artificial Sequence
  Description of Artificial Sequence: Synthetic oligonucleotide
  Description of Combined DNA/RNA Molecule: Synthetic oligonucleotide
ggatatgaaattttcttattgtgatga

SEQ ID NO: 866 - DNA, 27 bp, Artificial Sequence
  Description of Artificial Sequence: Synthetic oligonucleotide
  Description of Combined DNA/RNA Molecule: Synthetic oligonucleotide
aggccgctcaatttatgaatattatca

SEQ ID NO: 867 - DNA, 27 bp, Artificial Sequence
  Description of Artificial Sequence: Synthetic oligonucleotide
  Description of Combined DNA/RNA Molecule: Synthetic oligonucleotide
gccgctcaatttatgaatattatcatg

SEQ ID NO: 868 - DNA, 27 bp, Artificial Sequence
  Description of Artificial Sequence: Synthetic oligonucleotide
  Description of Combined DNA/RNA Molecule: Synthetic oligonucleotide
cgctcaatttatgaatattatcatgct

SEQ ID NO: 869 - DNA, 27 bp, Artificial Sequence
  Description of Artificial Sequence: Synthetic oligonucleotide
  Description of Combined DNA/RNA Molecule: Synthetic oligonucleotide
ctcaatttatgaatattatcatgcttt

SEQ ID NO: 870 - DNA, 27 bp, Artificial Sequence
  Description of Artificial Sequence: Synthetic oligonucleotide
  Description of Combined DNA/RNA Molecule: Synthetic oligonucleotide
caatttatgaatattatcatgctttgg

SEQ ID NO: 871 - DNA, 27 bp, Artificial Sequence
  Description of Artificial Sequence: Synthetic oligonucleotide
  Description of Combined DNA/RNA Molecule: Synthetic oligonucleotide
atttatgaatattatcatgctttggac

SEQ ID NO: 872 - DNA, 27 bp, Artificial Sequence
  Description of Artificial Sequence: Synthetic oligonucleotide
  Description of Combined DNA/RNA Molecule: Synthetic oligonucleotide
ttatgaatattatcatgctttggactc

SEQ ID NO: 873 - DNA, 27 bp, Artificial Sequence
  Description of Artificial Sequence: Synthetic oligonucleotide
  Description of Combined DNA/RNA Molecule: Synthetic oligonucleotide
atgaatattatcatgctttggactctg

SEQ ID NO: 874 - DNA, 27 bp, Artificial Sequence
  Description of Artificial Sequence: Synthetic oligonucleotide
  Description of Combined DNA/RNA Molecule: Synthetic oligonucleotide
tattatcatgctttggactctgatcat

SEQ ID NO: 875 - DNA, 27 bp, Artificial Sequence
  Description of Artificial Sequence: Synthetic oligonucleotide
  Description of Combined DNA/RNA Molecule: Synthetic oligonucleotide
tatcatgctttggactctgatcatctg

SEQ ID NO: 876 - DNA, 27 bp, Artificial Sequence
  Description of Artificial Sequence: Synthetic oligonucleotide
  Description of Combined DNA/RNA Molecule: Synthetic oligonucleotide
catgctttggactctgatcatctgacc

SEQ ID NO: 877 - DNA, 27 bp, Artificial Sequence
  Description of Artificial Sequence: Synthetic oligonucleotide
  Description of Combined DNA/RNA Molecule: Synthetic oligonucleotide
gctttggactctgatcatctgaccaaa

SEQ ID NO: 878 - DNA, 27 bp, Artificial Sequence
  Description of Artificial Sequence: Synthetic oligonucleotide
  Description of Combined DNA/RNA Molecule: Synthetic oligonucleotide
actctgatcatctgaccaaaactcatc

SEQ ID NO: 879 - DNA, 27 bp, Artificial Sequence
  Description of Artificial Sequence: Synthetic oligonucleotide
  Description of Combined DNA/RNA Molecule: Synthetic oligonucleotide
tctgatcatctgaccaaaactcatcat

SEQ ID NO: 880 - DNA, 27 bp, Artificial Sequence
  Description of Artificial Sequence: Synthetic oligonucleotide
  Description of Combined DNA/RNA Molecule: Synthetic oligonucleotide
tgatcatctgaccaaaactcatcatga

SEQ ID NO: 881 - DNA, 27 bp, Artificial Sequence
  Description of Artificial Sequence: Synthetic oligonucleotide
  Description of Combined DNA/RNA Molecule: Synthetic oligonucleotide
tcatgatatgtttactaaaggacaagt

SEQ ID NO: 882 - DNA, 27 bp, Artificial Sequence
  Description of Artificial Sequence: Synthetic oligonucleotide
  Description of Combined DNA/RNA Molecule: Synthetic oligonucleotide
atgatatgtttactaaaggacaagtca

SEQ ID NO: 883 - DNA, 27 bp, Artificial Sequence
  Description of Artificial Sequence: Synthetic oligonucleotide
  Description of Combined DNA/RNA Molecule: Synthetic oligonucleotide
gatatgtttactaaaggacaagtcacc

SEQ ID NO: 884 - DNA, 27 bp, Artificial Sequence
  Description of Artificial Sequence: Synthetic oligonucleotide
  Description of Combined DNA/RNA Molecule: Synthetic oligonucleotide
tatgtttactaaaggacaagtcaccac

SEQ ID NO: 885 - DNA, 27 bp, Artificial Sequence
  Description of Artificial Sequence: Synthetic oligonucleotide
  Description of Combined DNA/RNA Molecule: Synthetic oligonucleotide
tgtttactaaaggacaagtcaccacag

SEQ ID NO: 886 - DNA, 27 bp, Artificial Sequence
  Description of Artificial Sequence: Synthetic oligonucleotide
  Description of Combined DNA/RNA Molecule: Synthetic oligonucleotide
tttactaaaggacaagtcaccacagga

SEQ ID NO: 887 - DNA, 27 bp, Artificial Sequence
  Description of Artificial Sequence: Synthetic oligonucleotide
  Description of Combined DNA/RNA Molecule: Synthetic oligonucleotide
tactaaaggacaagtcaccacaggaca

SEQ ID NO: 888 - DNA, 27 bp, Artificial Sequence
  Description of Artificial Sequence: Synthetic oligonucleotide
  Description of Combined DNA/RNA Molecule: Synthetic oligonucleotide
ctaaaggacaagtcaccacaggacagt

SEQ ID NO: 889 - DNA, 27 bp, Artificial Sequence
  Description of Artificial Sequence: Synthetic oligonucleotide
  Description of Combined DNA/RNA Molecule: Synthetic oligonucleotide
aaaggacaagtcaccacaggacagtac

SEQ ID NO: 890 - DNA, 27 bp, Artificial Sequence
  Description of Artificial Sequence: Synthetic oligonucleotide
  Description of Combined DNA/RNA Molecule: Synthetic oligonucleotide
aggacaagtcaccacaggacagtacag

SEQ ID NO: 891 - DNA, 27 bp, Artificial Sequence
  Description of Artificial Sequence: Synthetic oligonucleotide
  Description of Combined DNA/RNA Molecule: Synthetic oligonucleotide
gacaagtcaccacaggacagtacagga

SEQ ID NO: 892 - DNA, 27 bp, Artificial Sequence
  Description of Artificial Sequence: Synthetic oligonucleotide
  Description of Combined DNA/RNA Molecule: Synthetic oligonucleotide
caagtcaccacaggacagtacaggatg

SEQ ID NO: 893 - DNA, 27 bp, Artificial Sequence
  Description of Artificial Sequence: Synthetic oligonucleotide
  Description of Combined DNA/RNA Molecule: Synthetic oligonucleotide
agtcaccacaggacagtacaggatgct

SEQ ID NO: 894 - DNA, 27 bp, Artificial Sequence
  Description of Artificial Sequence: Synthetic oligonucleotide
  Description of Combined DNA/RNA Molecule: Synthetic oligonucleotide
tcaccacaggacagtacaggatgcttg

SEQ ID NO: 895 - DNA, 27 bp, Artificial Sequence
  Description of Artificial Sequence: Synthetic oligonucleotide
  Description of Combined DNA/RNA Molecule: Synthetic oligonucleotide
accacaggacagtacaggatgcttgcc

SEQ ID NO: 896 - DNA, 27 bp, Artificial Sequence
  Description of Artificial Sequence: Synthetic oligonucleotide
  Description of Combined DNA/RNA Molecule: Synthetic oligonucleotide
cacaggacagtacaggatgcttgccaa

SEQ ID NO: 897 - DNA, 27 bp, Artificial Sequence
  Description of Artificial Sequence: Synthetic oligonucleotide
  Description of Combined DNA/RNA Molecule: Synthetic oligonucleotide
caggacagtacaggatgcttgccaaaa

SEQ ID NO: 898 - DNA, 27 bp, Artificial Sequence
  Description of Artificial Sequence: Synthetic oligonucleotide
  Description of Combined DNA/RNA Molecule: Synthetic oligonucleotide
ggacagtacaggatgcttgccaaaaga

SEQ ID NO: 899 - DNA, 27 bp, Artificial Sequence
  Description of Artificial Sequence: Synthetic oligonucleotide
  Description of Combined DNA/RNA Molecule: Synthetic oligonucleotide
acagtacaggatgcttgccaaaagagg

SEQ ID NO: 900 - DNA, 27 bp, Artificial Sequence
  Description of Artificial Sequence: Synthetic oligonucleotide
  Description of Combined DNA/RNA Molecule: Synthetic oligonucleotide
agtacaggatgcttgccaaaagaggtg

SEQ ID NO: 901 - DNA, 27 bp, Artificial Sequence
  Description of Artificial Sequence: Synthetic oligonucleotide
  Description of Combined DNA/RNA Molecule: Synthetic oligonucleotide
tacaggatgcttgccaaaagaggtgga

SEQ ID NO: 902 - DNA, 27 bp, Artificial Sequence
  Description of Artificial Sequence: Synthetic oligonucleotide
  Description of Combined DNA/RNA Molecule: Synthetic oligonucleotide
caggatgcttgccaaaagaggtggata

SEQ ID NO: 903 - DNA, 27 bp, Artificial Sequence
  Description of Artificial Sequence: Synthetic oligonucleotide
  Description of Combined DNA/RNA Molecule: Synthetic oligonucleotide
ggatgcttgccaaaagaggtggatatg

SEQ ID NO: 904 - DNA, 27 bp, Artificial Sequence
  Description of Artificial Sequence: Synthetic oligonucleotide
  Description of Combined DNA/RNA Molecule: Synthetic oligonucleotide
atgcttgccaaaagaggtggatatgtc

SEQ ID NO: 905 - DNA, 27 bp, Artificial Sequence
  Description of Artificial Sequence: Synthetic oligonucleotide
  Description of Combined DNA/RNA Molecule: Synthetic oligonucleotide
gcttgccaaaagaggtggatatgtctg

SEQ ID NO: 906 - DNA, 27 bp, Artificial Sequence
  Description of Artificial Sequence: Synthetic oligonucleotide
  Description of Combined DNA/RNA Molecule: Synthetic oligonucleotide
ttgccaaaagaggtggatatgtctggg

SEQ ID NO: 907 - DNA, 27 bp, Artificial Sequence
  Description of Artificial Sequence: Synthetic oligonucleotide
  Description of Combined DNA/RNA Molecule: Synthetic oligonucleotide
gccaaaagaggtggatatgtctgggtt

SEQ ID NO: 908 - DNA, 27 bp, Artificial Sequence
  Description of Artificial Sequence: Synthetic oligonucleotide
  Description of Combined DNA/RNA Molecule: Synthetic oligonucleotide
caaaagaggtggatatgtctgggttga

SEQ ID NO: 909 - DNA, 27 bp, Artificial Sequence
  Description of Artificial Sequence: Synthetic oligonucleotide
  Description of Combined DNA/RNA Molecule: Synthetic oligonucleotide
aaagaggtggatatgtctgggttgaaa

SEQ ID NO: 910 - DNA, 27 bp, Artificial Sequence
  Description of Artificial Sequence: Synthetic oligonucleotide
  Description of Combined DNA/RNA Molecule: Synthetic oligonucleotide
agaggtggatatgtctgggttgaaact

SEQ ID NO: 911 - DNA, 27 bp, Artificial Sequence
  Description of Artificial Sequence: Synthetic oligonucleotide
  Description of Combined DNA/RNA Molecule: Synthetic oligonucleotide
aggtggatatgtctgggttgaaactca

SEQ ID NO: 912 - DNA, 27 bp, Artificial Sequence
  Description of Artificial Sequence: Synthetic oligonucleotide
  Description of Combined DNA/RNA Molecule: Synthetic oligonucleotide
gtggatatgtctgggttgaaactcaag

SEQ ID NO: 913 - DNA, 27 bp, Artificial Sequence
  Description of Artificial Sequence: Synthetic oligonucleotide
  Description of Combined DNA/RNA Molecule: Synthetic oligonucleotide
ggatatgtctgggttgaaactcaagca

SEQ ID NO: 914 - DNA, 27 bp, Artificial Sequence
  Description of Artificial Sequence: Synthetic oligonucleotide
  Description of Combined DNA/RNA Molecule: Synthetic oligonucleotide
atatgtctgggttgaaactcaagcaac

SEQ ID NO: 915 - DNA, 27 bp, Artificial Sequence
  Description of Artificial Sequence: Synthetic oligonucleotide
  Description of Combined DNA/RNA Molecule: Synthetic oligonucleotide
atgtctgggttgaaactcaagcaactg

SEQ ID NO: 916 - DNA, 27 bp, Artificial Sequence
  Description of Artificial Sequence: Synthetic oligonucleotide
  Description of Combined DNA/RNA Molecule: Synthetic oligonucleotide
gtctgggttgaaactcaagcaactgtc

SEQ ID NO: 917 - DNA, 27 bp, Artificial Sequence
  Description of Artificial Sequence: Synthetic oligonucleotide
  Description of Combined DNA/RNA Molecule: Synthetic oligonucleotide
ctgggttgaaactcaagcaactgtcat

SEQ ID NO: 918 - DNA, 27 bp, Artificial Sequence
  Description of Artificial Sequence: Synthetic oligonucleotide
  Description of Combined DNA/RNA Molecule: Synthetic oligonucleotide
gggttgaaactcaagcaactgtcatat

SEQ ID NO: 919 - DNA, 27 bp, Artificial Sequence
  Description of Artificial Sequence: Synthetic oligonucleotide
  Description of Combined DNA/RNA Molecule: Synthetic oligonucleotide
gttgaaactcaagcaactgtcatatat

SEQ ID NO: 920 - DNA, 27 bp, Artificial Sequence
  Description of Artificial Sequence: Synthetic oligonucleotide
  Description of Combined DNA/RNA Molecule: Synthetic oligonucleotide
tgaaactcaagcaactgtcatatataa

SEQ ID NO: 921 - DNA, 27 bp, Artificial Sequence
  Description of Artificial Sequence: Synthetic oligonucleotide
  Description of Combined DNA/RNA Molecule: Synthetic oligonucleotide
aaactcaagcaactgtcatatataaca

SEQ ID NO: 922 - DNA, 27 bp, Artificial Sequence
  Description of Artificial Sequence: Synthetic oligonucleotide
  Description of Combined DNA/RNA Molecule: Synthetic oligonucleotide
actcaagcaactgtcatatataacacc

SEQ ID NO: 923 - DNA, 27 bp, Artificial Sequence
  Description of Artificial Sequence: Synthetic oligonucleotide
  Description of Combined DNA/RNA Molecule: Synthetic oligonucleotide
tcaagcaactgtcatatataacaccaa

SEQ ID NO: 924 - DNA, 27 bp, Artificial Sequence
  Description of Artificial Sequence: Synthetic oligonucleotide
  Description of Combined DNA/RNA Molecule: Synthetic oligonucleotide
gagtggtattattcagcacgacttgat

SEQ ID NO: 925 - DNA, 27 bp, Artificial Sequence
  Description of Artificial Sequence: Synthetic oligonucleotide
  Description of Combined DNA/RNA Molecule: Synthetic oligonucleotide
gtggtattattcagcacgacttgattt

SEQ ID NO: 926 - DNA, 27 bp, Artificial Sequence
  Description of Artificial Sequence: Synthetic oligonucleotide
  Description of Combined DNA/RNA Molecule: Synthetic oligonucleotide
ggtattattcagcacgacttgattttc

SEQ ID NO: 927 - DNA, 27 bp, Artificial Sequence
  Description of Artificial Sequence: Synthetic oligonucleotide
  Description of Combined DNA/RNA Molecule: Synthetic oligonucleotide
tattattcagcacgacttgattttctc

SEQ ID NO: 928 - DNA, 27 bp, Artificial Sequence
  Description of Artificial Sequence: Synthetic oligonucleotide
  Description of Combined DNA/RNA Molecule: Synthetic oligonucleotide
ttattcagcacgacttgattttctccc

SEQ ID NO: 929 - DNA, 27 bp, Artificial Sequence
  Description of Artificial Sequence: Synthetic oligonucleotide
  Description of Combined DNA/RNA Molecule: Synthetic oligonucleotide
attcagcacgacttgattttctccctt

SEQ ID NO: 930 - DNA, 27 bp, Artificial Sequence
  Description of Artificial Sequence: Synthetic oligonucleotide
  Description of Combined DNA/RNA Molecule: Synthetic oligonucleotide
tcagcacgacttgattttctcccttca

SEQ ID NO: 931 - DNA, 27 bp, Artificial Sequence
  Description of Artificial Sequence: Synthetic oligonucleotide
  Description of Combined DNA/RNA Molecule: Synthetic oligonucleotide
agcacgacttgattttctcccttcaac

SEQ ID NO: 932 - DNA, 27 bp, Artificial Sequence
  Description of Artificial Sequence: Synthetic oligonucleotide
  Description of Combined DNA/RNA Molecule: Synthetic oligonucleotide
cacgacttgattttctcccttcaacaa

SEQ ID NO: 933 - DNA, 27 bp, Artificial Sequence
  Description of Artificial Sequence: Synthetic oligonucleotide
  Description of Combined DNA/RNA Molecule: Synthetic oligonucleotide
cgacttgattttctcccttcaacaaac

SEQ ID NO: 934 - DNA, 27 bp, Artificial Sequence
  Description of Artificial Sequence: Synthetic oligonucleotide
  Description of Combined DNA/RNA Molecule: Synthetic oligonucleotide
acttgattttctcccttcaacaaacag

SEQ ID NO: 935 - DNA, 27 bp, Artificial Sequence
  Description of Artificial Sequence: Synthetic oligonucleotide
  Description of Combined DNA/RNA Molecule: Synthetic oligonucleotide
ttgattttctcccttcaacaaacagaa

SEQ ID NO: 936 - DNA, 27 bp, Artificial Sequence
  Description of Artificial Sequence: Synthetic oligonucleotide
  Description of Combined DNA/RNA Molecule: Synthetic oligonucleotide
gattttctcccttcaacaaacagaatg

SEQ ID NO: 937 - DNA, 27 bp, Artificial Sequence
  Description of Artificial Sequence: Synthetic oligonucleotide
  Description of Combined DNA/RNA Molecule: Synthetic oligonucleotide
ttttctcccttcaacaaacagaatgtg

SEQ ID NO: 938 - DNA, 27 bp, Artificial Sequence
  Description of Artificial Sequence: Synthetic oligonucleotide
  Description of Combined DNA/RNA Molecule: Synthetic oligonucleotide
ggttgaatcttcagatatgaaaatgac

SEQ ID NO: 939 - DNA, 27 bp, Artificial Sequence
  Description of Artificial Sequence: Synthetic oligonucleotide
  Description of Combined DNA/RNA Molecule: Synthetic oligonucleotide
attcaccaaagttgaatcagaagatac

SEQ ID NO: 940 - DNA, 27 bp, Artificial Sequence
  Description of Artificial Sequence: Synthetic oligonucleotide
  Description of Combined DNA/RNA Molecule: Synthetic oligonucleotide
aagatacaagtagcctctttgacaaac

SEQ ID NO: 941 - DNA, 27 bp, Artificial Sequence
  Description of Artificial Sequence: Synthetic oligonucleotide
  Description of Combined DNA/RNA Molecule: Synthetic oligonucleotide
cacaatcatatctttagattttggcag

SEQ ID NO: 942 - DNA, 27 bp, Artificial Sequence
  Description of Artificial Sequence: Synthetic oligonucleotide
  Description of Combined DNA/RNA Molecule: Synthetic oligonucleotide
gaagtaccattatataatgatgtaatg

SEQ ID NO: 943 - DNA, 27 bp, Artificial Sequence
  Description of Artificial Sequence: Synthetic oligonucleotide
  Description of Combined DNA/RNA Molecule: Synthetic oligonucleotide
accattatataatgatgtaatgctccc

SEQ ID NO: 944 - DNA, 27 bp, Artificial Sequence
  Description of Artificial Sequence: Synthetic oligonucleotide
  Description of Combined DNA/RNA Molecule: Synthetic oligonucleotide
attacccaccgctgaaacgccaaagcc

SEQ ID NO: 945 - DNA, 27 bp, Artificial Sequence
  Description of Artificial Sequence: Synthetic oligonucleotide
  Description of Combined DNA/RNA Molecule: Synthetic oligonucleotide
gccaaagccacttcgaagtagtgctga

SEQ ID NO: 946 - DNA, 27 bp, Artificial Sequence
  Description of Artificial Sequence: Synthetic oligonucleotide
  Description of Combined DNA/RNA Molecule: Synthetic oligonucleotide
caaagccacttcgaagtagtgctgacc

SEQ ID NO: 947 - DNA, 27 bp, Artificial Sequence
  Description of Artificial Sequence: Synthetic oligonucleotide
  Description of Combined DNA/RNA Molecule: Synthetic oligonucleotide
aagccacttcgaagtagtgctgaccct

SEQ ID NO: 948 - DNA, 27 bp, Artificial Sequence
  Description of Artificial Sequence: Synthetic oligonucleotide
  Description of Combined DNA/RNA Molecule: Synthetic oligonucleotide
gccacttcgaagtagtgctgaccctgc

SEQ ID NO: 949 - DNA, 27 bp, Artificial Sequence
  Description of Artificial Sequence: Synthetic oligonucleotide
  Description of Combined DNA/RNA Molecule: Synthetic oligonucleotide
cttcgaagtagtgctgaccctgcactc

SEQ ID NO: 950 - DNA, 27 bp, Artificial Sequence
  Description of Artificial Sequence: Synthetic oligonucleotide
  Description of Combined DNA/RNA Molecule: Synthetic oligonucleotide
aagaagttgcattaaaattagaaccaa

SEQ ID NO: 951 - DNA, 27 bp, Artificial Sequence
  Description of Artificial Sequence: Synthetic oligonucleotide
  Description of Combined DNA/RNA Molecule: Synthetic oligonucleotide
cgatggaagcactagacaaagttcacc

SEQ ID NO: 952 - DNA, 27 bp, Artificial Sequence
  Description of Artificial Sequence: Synthetic oligonucleotide
  Description of Combined DNA/RNA Molecule: Synthetic oligonucleotide
atggaagcactagacaaagttcacctg

SEQ ID NO: 953 - DNA, 27 bp, Artificial Sequence
  Description of Artificial Sequence: Synthetic oligonucleotide
  Description of Combined DNA/RNA Molecule: Synthetic oligonucleotide
ggaagcactagacaaagttcacctgag

SEQ ID NO: 954 - DNA, 27 bp, Artificial Sequence
  Description of Artificial Sequence: Synthetic oligonucleotide
  Description of Combined DNA/RNA Molecule: Synthetic oligonucleotide
aagcactagacaaagttcacctgagcc

SEQ ID NO: 955 - DNA, 27 bp, Artificial Sequence
  Description of Artificial Sequence: Synthetic oligonucleotide
  Description of Combined DNA/RNA Molecule: Synthetic oligonucleotide
gcactagacaaagttcacctgagccta

SEQ ID NO: 956 - DNA, 27 bp, Artificial Sequence
  Description of Artificial Sequence: Synthetic oligonucleotide
  Description of Combined DNA/RNA Molecule: Synthetic oligonucleotide
actagacaaagttcacctgagcctaat

SEQ ID NO: 957 - DNA, 27 bp, Artificial Sequence
  Description of Artificial Sequence: Synthetic oligonucleotide
  Description of Combined DNA/RNA Molecule: Synthetic oligonucleotide
ccagtgaatattgtttttatgtggata

SEQ ID NO: 958 - DNA, 27 bp, Artificial Sequence
  Description of Artificial Sequence: Synthetic oligonucleotide
  Description of Combined DNA/RNA Molecule: Synthetic oligonucleotide
tattgtttttatgtggatagtgatatg

SEQ ID NO: 959 - DNA, 27 bp, Artificial Sequence
  Description of Artificial Sequence: Synthetic oligonucleotide
  Description of Combined DNA/RNA Molecule: Synthetic oligonucleotide
tggtagaaaaactttttgctgaagaca

SEQ ID NO: 960 - DNA, 27 bp, Artificial Sequence
  Description of Artificial Sequence: Synthetic oligonucleotide
  Description of Combined DNA/RNA Molecule: Synthetic oligonucleotide
agctccctatatcccaatggatgatga

SEQ ID NO: 961 - DNA, 27 bp, Artificial Sequence
  Description of Artificial Sequence: Synthetic oligonucleotide
  Description of Combined DNA/RNA Molecule: Synthetic oligonucleotide
ctccctatatcccaatggatgatgact

SEQ ID NO: 962 - DNA, 27 bp, Artificial Sequence
  Description of Artificial Sequence: Synthetic oligonucleotide
  Description of Combined DNA/RNA Molecule: Synthetic oligonucleotide
ccctatatcccaatggatgatgacttc

SEQ ID NO: 963 - DNA, 27 bp, Artificial Sequence
  Description of Artificial Sequence: Synthetic oligonucleotide
  Description of Combined DNA/RNA Molecule: Synthetic oligonucleotide
ctatatcccaatggatgatgacttcca

SEQ ID NO: 964 - DNA, 27 bp, Artificial Sequence
  Description of Artificial Sequence: Synthetic oligonucleotide
  Description of Combined DNA/RNA Molecule: Synthetic oligonucleotide
cgatcagttgtcaccattagaaagcag

SEQ ID NO: 965 - DNA, 27 bp, Artificial Sequence
  Description of Artificial Sequence: Synthetic oligonucleotide
  Description of Combined DNA/RNA Molecule: Synthetic oligonucleotide
cagttccgcaagccctgaaagcgcaag

SEQ ID NO: 966 - DNA, 27 bp, Artificial Sequence
  Description of Artificial Sequence: Synthetic oligonucleotide
  Description of Combined DNA/RNA Molecule: Synthetic oligonucleotide
gttccgcaagccctgaaagcgcaagtc

SEQ ID NO: 967 - DNA, 27 bp, Artificial Sequence
  Description of Artificial Sequence: Synthetic oligonucleotide
  Description of Combined DNA/RNA Molecule: Synthetic oligonucleotide
cactgatgaattaaaaacagtgacaaa

SEQ ID NO: 968 - DNA, 27 bp, Artificial Sequence
  Description of Artificial Sequence: Synthetic oligonucleotide
  Description of Combined DNA/RNA Molecule: Synthetic oligonucleotide
ggaagacattaaaatattgattgcatc

SEQ ID NO: 969 - DNA, 27 bp, Artificial Sequence
  Description of Artificial Sequence: Synthetic oligonucleotide
  Description of Combined DNA/RNA Molecule: Synthetic oligonucleotide
aggagtcatagaacagacagaaaaatc

SEQ ID NO: 970 - DNA, 27 bp, Artificial Sequence
  Description of Artificial Sequence: Synthetic oligonucleotide
  Description of Combined DNA/RNA Molecule: Synthetic oligonucleotide
aagatactagctttgcagaatgctcag

SEQ ID NO: 971 - DNA, 27 bp, Artificial Sequence
  Description of Artificial Sequence: Synthetic oligonucleotide
  Description of Combined DNA/RNA Molecule: Synthetic oligonucleotide
ctcagagaaagcgaaaaatggaacatg

SEQ ID NO: 972 - DNA, 27 bp, Artificial Sequence
  Description of Artificial Sequence: Synthetic oligonucleotide
  Description of Combined DNA/RNA Molecule: Synthetic oligonucleotide
aaagcgaaaaatggaacatgatggttc

SEQ ID NO: 973 - DNA, 27 bp, Artificial Sequence
  Description of Artificial Sequence: Synthetic oligonucleotide
  Description of Combined DNA/RNA Molecule: Synthetic oligonucleotide
agcgaaaaatggaacatgatggttcac

SEQ ID NO: 974 - DNA, 27 bp, Artificial Sequence
  Description of Artificial Sequence: Synthetic oligonucleotide
  Description of Combined DNA/RNA Molecule: Synthetic oligonucleotide
caagcagtaggaattggaacattatta

SEQ ID NO: 975 - DNA, 27 bp, Artificial Sequence
  Description of Artificial Sequence: Synthetic oligonucleotide
  Description of Combined DNA/RNA Molecule: Synthetic oligonucleotide
aaatctagtgaacagaatggaatggag

SEQ ID NO: 976 - DNA, 27 bp, Artificial Sequence
  Description of Artificial Sequence: Synthetic oligonucleotide
  Description of Combined DNA/RNA Molecule: Synthetic oligonucleotide
agcaaaagacaattattttaataccct

SEQ ID NO: 977 - DNA, 27 bp, Artificial Sequence
  Description of Artificial Sequence: Synthetic oligonucleotide
  Description of Combined DNA/RNA Molecule: Synthetic oligonucleotide
aaagtggattaccacagctgaccagtt

SEQ ID NO: 978 - DNA, 27 bp, Artificial Sequence
  Description of Artificial Sequence: Synthetic oligonucleotide
  Description of Combined DNA/RNA Molecule: Synthetic oligonucleotide
agtggattaccacagctgaccagttat

SEQ ID NO: 979 - DNA, 27 bp, Artificial Sequence
  Description of Artificial Sequence: Synthetic oligonucleotide
  Description of Combined DNA/RNA Molecule: Synthetic oligonucleotide
tggattaccacagctgaccagttatga

SEQ ID NO: 980 - DNA, 27 bp, Artificial Sequence
  Description of Artificial Sequence: Synthetic oligonucleotide
  Description of Combined DNA/RNA Molecule: Synthetic oligonucleotide
gattaccacagctgaccagttatgatt

SEQ ID NO: 981 - DNA, 27 bp, Artificial Sequence
  Description of Artificial Sequence: Synthetic oligonucleotide
  Description of Combined DNA/RNA Molecule: Synthetic oligonucleotide
atgattgtgaagttaatgctcctatac

SEQ ID NO: 982 - DNA, 27 bp, Artificial Sequence
  Description of Artificial Sequence: Synthetic oligonucleotide
  Description of Combined DNA/RNA Molecule: Synthetic oligonucleotide
ctatacaaggcagcagaaacctactgc

SEQ ID NO: 983 - DNA, 27 bp, Artificial Sequence
  Description of Artificial Sequence: Synthetic oligonucleotide
  Description of Combined DNA/RNA Molecule: Synthetic oligonucleotide
atacaaggcagcagaaacctactgcag

SEQ ID NO: 984 - DNA, 27 bp, Artificial Sequence
  Description of Artificial Sequence: Synthetic oligonucleotide
  Description of Combined DNA/RNA Molecule: Synthetic oligonucleotide
acaaggcagcagaaacctactgcaggg

SEQ ID NO: 985 - DNA, 27 bp, Artificial Sequence
  Description of Artificial Sequence: Synthetic oligonucleotide
  Description of Combined DNA/RNA Molecule: Synthetic oligonucleotide
aaggcagcagaaacctactgcagggtg

SEQ ID NO: 986 - DNA, 27 bp, Artificial Sequence
  Description of Artificial Sequence: Synthetic oligonucleotide
  Description of Combined DNA/RNA Molecule: Synthetic oligonucleotide
ggcagcagaaacctactgcagggtgaa

SEQ ID NO: 987 - DNA, 27 bp, Artificial Sequence
  Description of Artificial Sequence: Synthetic oligonucleotide
  Description of Combined DNA/RNA Molecule: Synthetic oligonucleotide
cagcagaaacctactgcagggtgaaga

SEQ ID NO: 988 - DNA, 27 bp, Artificial Sequence
  Description of Artificial Sequence: Synthetic oligonucleotide
  Description of Combined DNA/RNA Molecule: Synthetic oligonucleotide
gcagaaacctactgcagggtgaagaat

SEQ ID NO: 989 - DNA, 27 bp, Artificial Sequence
  Description of Artificial Sequence: Synthetic oligonucleotide
  Description of Combined DNA/RNA Molecule: Synthetic oligonucleotide
agaaacctactgcagggtgaagaatta

SEQ ID NO: 990 - DNA, 27 bp, Artificial Sequence
  Description of Artificial Sequence: Synthetic oligonucleotide
  Description of Combined DNA/RNA Molecule: Synthetic oligonucleotide
aaacctactgcagggtgaagaattact

SEQ ID NO: 991 - DNA, 27 bp, Artificial Sequence
  Description of Artificial Sequence: Synthetic oligonucleotide
  Description of Combined DNA/RNA Molecule: Synthetic oligonucleotide
acctactgcagggtgaagaattactca

SEQ ID NO: 992 - DNA, 27 bp, Artificial Sequence
  Description of Artificial Sequence: Synthetic oligonucleotide
  Description of Combined DNA/RNA Molecule: Synthetic oligonucleotide
ctactgcagggtgaagaattactcaga

SEQ ID NO: 993 - DNA, 27 bp, Artificial Sequence
  Description of Artificial Sequence: Synthetic oligonucleotide
  Description of Combined DNA/RNA Molecule: Synthetic oligonucleotide
actgcagggtgaagaattactcagagc

SEQ ID NO: 994 - DNA, 27 bp, Artificial Sequence
  Description of Artificial Sequence: Synthetic oligonucleotide
  Description of Combined DNA/RNA Molecule: Synthetic oligonucleotide
tgcagggtgaagaattactcagagctt

SEQ ID NO: 995 - DNA, 27 bp, Artificial Sequence
  Description of Artificial Sequence: Synthetic oligonucleotide
  Description of Combined DNA/RNA Molecule: Synthetic oligonucleotide
cagggtgaagaattactcagagctttg

SEQ ID NO: 996 - DNA, 27 bp, Artificial Sequence
  Description of Artificial Sequence: Synthetic oligonucleotide
  Description of Combined DNA/RNA Molecule: Synthetic oligonucleotide
gggtgaagaattactcagagctttgga

SEQ ID NO: 997 - DNA, 27 bp, Artificial Sequence
  Description of Artificial Sequence: Synthetic oligonucleotide
  Description of Combined DNA/RNA Molecule: Synthetic oligonucleotide
gtgaagaattactcagagctttggatc

SEQ ID NO: 998 - DNA, 27 bp, Artificial Sequence
  Description of Artificial Sequence: Synthetic oligonucleotide
  Description of Combined DNA/RNA Molecule: Synthetic oligonucleotide
gaagaattactcagagctttggatcaa

SEQ ID NO: 999 - DNA, 27 bp, Artificial Sequence
  Description of Artificial Sequence: Synthetic oligonucleotide
  Description of Combined DNA/RNA Molecule: Synthetic oligonucleotide
agaattactcagagctttggatcaagt

SEQ ID NO: 1000 - DNA, 27 bp, Artificial Sequence
  Description of Artificial Sequence: Synthetic oligonucleotide
  Description of Combined DNA/RNA Molecule: Synthetic oligonucleotide
aattactcagagctttggatcaagtta

SEQ ID NO: 1001 - DNA, 27 bp, Artificial Sequence
  Description of Artificial Sequence: Synthetic oligonucleotide
  Description of Combined DNA/RNA Molecule: Synthetic oligonucleotide
ttactcagagctttggatcaagttaac

SEQ ID NO: 1002 - DNA, 27 bp, Artificial Sequence
  Description of Artificial Sequence: Synthetic oligonucleotide
  Description of Combined DNA/RNA Molecule: Synthetic oligonucleotide
actcagagctttggatcaagttaactg

SEQ ID NO: 1003 - DNA, 27 bp, Artificial Sequence
  Description of Artificial Sequence: Synthetic oligonucleotide
  Description of Combined DNA/RNA Molecule: Synthetic oligonucleotide
tcagagctttggatcaagttaactgag

SEQ ID NO: 1004 - DNA, 27 bp, Artificial Sequence
  Description of Artificial Sequence: Synthetic oligonucleotide
  Description of Combined DNA/RNA Molecule: Synthetic oligonucleotide
agagctttggatcaagttaactgagct

SEQ ID NO: 1005 - DNA, 27 bp, Artificial Sequence
  Description of Artificial Sequence: Synthetic oligonucleotide
  Description of Combined DNA/RNA Molecule: Synthetic oligonucleotide
agctttggatcaagttaactgagcttt

SEQ ID NO: 1006 - DNA, 27 bp, Artificial Sequence
  Description of Artificial Sequence: Synthetic oligonucleotide
  Description of Combined DNA/RNA Molecule: Synthetic oligonucleotide
ctttggatcaagttaactgagcttttt

SEQ ID NO: 1007 - DNA, 27 bp, Artificial Sequence
  Description of Artificial Sequence: Synthetic oligonucleotide
  Description of Combined DNA/RNA Molecule: Synthetic oligonucleotide
tggatcaagttaactgagctttttctt

SEQ ID NO: 1008 - DNA, 27 bp, Artificial Sequence
  Description of Artificial Sequence: Synthetic oligonucleotide
  Description of Combined DNA/RNA Molecule: Synthetic oligonucleotide
aactgagctttttcttaatttcattcc

SEQ ID NO: 1009 - DNA, 27 bp, Artificial Sequence
  Description of Artificial Sequence: Synthetic oligonucleotide
  Description of Combined DNA/RNA Molecule: Synthetic oligonucleotide
gagctttttcttaatttcattcctttt

SEQ ID NO: 1010 - DNA, 27 bp, Artificial Sequence
  Description of Artificial Sequence: Synthetic oligonucleotide
  Description of Combined DNA/RNA Molecule: Synthetic oligonucleotide
cttaatttcattcctttttttggacac

SEQ ID NO: 1011 - DNA, 27 bp, Artificial Sequence
  Description of Artificial Sequence: Synthetic oligonucleotide
  Description of Combined DNA/RNA Molecule: Synthetic oligonucleotide
ttcattcctttttttggacactggtgg

SEQ ID NO: 1012 - DNA, 27 bp, Artificial Sequence
  Description of Artificial Sequence: Synthetic oligonucleotide
  Description of Combined DNA/RNA Molecule: Synthetic oligonucleotide
tttttttggacactggtggctcattac

SEQ ID NO: 1013 - DNA, 27 bp, Artificial Sequence
  Description of Artificial Sequence: Synthetic oligonucleotide
  Description of Combined DNA/RNA Molecule: Synthetic oligonucleotide
tttttggacactggtggctcattacct

SEQ ID NO: 1014 - DNA, 27 bp, Artificial Sequence
  Description of Artificial Sequence: Synthetic oligonucleotide
  Description of Combined DNA/RNA Molecule: Synthetic oligonucleotide
aagcagtctatttatattttctacatc

SEQ ID NO: 1015 - DNA, 27 bp, Artificial Sequence
  Description of Artificial Sequence: Synthetic oligonucleotide
  Description of Combined DNA/RNA Molecule: Synthetic oligonucleotide
gcagtctatttatattttctacatcta

SEQ ID NO: 1016 - DNA, 27 bp, Artificial Sequence
  Description of Artificial Sequence: Synthetic oligonucleotide
  Description of Combined DNA/RNA Molecule: Synthetic oligonucleotide
ctatttatattttctacatctaatttt

SEQ ID NO: 1017 - DNA, 27 bp, Artificial Sequence
  Description of Artificial Sequence: Synthetic oligonucleotide
  Description of Combined DNA/RNA Molecule: Synthetic oligonucleotide
catctaattttagaagcctggctacaa

SEQ ID NO: 1018 - DNA, 27 bp, Artificial Sequence
  Description of Artificial Sequence: Synthetic oligonucleotide
  Description of Combined DNA/RNA Molecule: Synthetic oligonucleotide
tctaattttagaagcctggctacaata

SEQ ID NO: 1019 - DNA, 27 bp, Artificial Sequence
  Description of Artificial Sequence: Synthetic oligonucleotide
  Description of Combined DNA/RNA Molecule: Synthetic oligonucleotide
taattttagaagcctggctacaatact

SEQ ID NO: 1020 - DNA, 27 bp, Artificial Sequence
  Description of Artificial Sequence: Synthetic oligonucleotide
  Description of Combined DNA/RNA Molecule: Synthetic oligonucleotide
attttagaagcctggctacaatactgc

SEQ ID NO: 1021 - DNA, 27 bp, Artificial Sequence
  Description of Artificial Sequence: Synthetic oligonucleotide
  Description of Combined DNA/RNA Molecule: Synthetic oligonucleotide
tttagaagcctggctacaatactgcac

SEQ ID NO: 1022 - DNA, 27 bp, Artificial Sequence
  Description of Artificial Sequence: Synthetic oligonucleotide
  Description of Combined DNA/RNA Molecule: Synthetic oligonucleotide
tagaagcctggctacaatactgcacaa

SEQ ID NO: 1023 - DNA, 27 bp, Artificial Sequence
  Description of Artificial Sequence: Synthetic oligonucleotide
  Description of Combined DNA/RNA Molecule: Synthetic oligonucleotide
gaagcctggctacaatactgcacaaac

SEQ ID NO: 1024 - DNA, 27 bp, Artificial Sequence
  Description of Artificial Sequence: Synthetic oligonucleotide
  Description of Combined DNA/RNA Molecule: Synthetic oligonucleotide
agcctggctacaatactgcacaaactt

SEQ ID NO: 1025 - DNA, 27 bp, Artificial Sequence
  Description of Artificial Sequence: Synthetic oligonucleotide
  Description of Combined DNA/RNA Molecule: Synthetic oligonucleotide
cctggctacaatactgcacaaacttgg

SEQ ID NO: 1026 - DNA, 27 bp, Artificial Sequence
  Description of Artificial Sequence: Synthetic oligonucleotide
  Description of Combined DNA/RNA Molecule: Synthetic oligonucleotide
tggctacaatactgcacaaacttggtt

SEQ ID NO: 1027 - DNA, 27 bp, Artificial Sequence
  Description of Artificial Sequence: Synthetic oligonucleotide
  Description of Combined DNA/RNA Molecule: Synthetic oligonucleotide
cttaatttacattaatgctctttttta

SEQ ID NO: 1028 - DNA, 27 bp, Artificial Sequence
  Description of Artificial Sequence: Synthetic oligonucleotide
  Description of Combined DNA/RNA Molecule: Synthetic oligonucleotide
attaatgctcttttttagtatgttctt

SEQ ID NO: 1029 - DNA, 27 bp, Artificial Sequence
  Description of Artificial Sequence: Synthetic oligonucleotide
  Description of Combined DNA/RNA Molecule: Synthetic oligonucleotide
taatgctcttttttagtatgttcttta

SEQ ID NO: 1030 - DNA, 27 bp, Artificial Sequence
  Description of Artificial Sequence: Synthetic oligonucleotide
  Description of Combined DNA/RNA Molecule: Synthetic oligonucleotide
aatgctcttttttagtatgttctttaa

SEQ ID NO: 1031 - DNA, 27 bp, Artificial Sequence
  Description of Artificial Sequence: Synthetic oligonucleotide
  Description of Combined DNA/RNA Molecule: Synthetic oligonucleotide
ttttagtatgttctttaatgctggatc

SEQ ID NO: 1032 - DNA, 27 bp, Artificial Sequence
  Description of Artificial Sequence: Synthetic oligonucleotide
  Description of Combined DNA/RNA Molecule: Synthetic oligonucleotide
agtatgttctttaatgctggatcacag

SEQ ID NO: 1033 - DNA, 27 bp, Artificial Sequence
  Description of Artificial Sequence: Synthetic oligonucleotide
  Description of Combined DNA/RNA Molecule: Synthetic oligonucleotide
tctttaatgctggatcacagacagctc

SEQ ID NO: 1034 - DNA, 27 bp, Artificial Sequence
  Description of Artificial Sequence: Synthetic oligonucleotide
  Description of Combined DNA/RNA Molecule: Synthetic oligonucleotide
aatgctggatcacagacagctcatttt

SEQ ID NO: 1035 - DNA, 27 bp, Artificial Sequence
  Description of Artificial Sequence: Synthetic oligonucleotide
  Description of Combined DNA/RNA Molecule: Synthetic oligonucleotide
agctcattttctcagttttttggtatt

SEQ ID NO: 1036 - DNA, 27 bp, Artificial Sequence
  Description of Artificial Sequence: Synthetic oligonucleotide
  Description of Combined DNA/RNA Molecule: Synthetic oligonucleotide
aaaaaatgcacctttttatttatttat

SEQ ID NO: 1037 - DNA, 27 bp, Artificial Sequence
  Description of Artificial Sequence: Synthetic oligonucleotide
  Description of Combined DNA/RNA Molecule: Synthetic oligonucleotide
aaaatgcacctttttatttatttattt

SEQ ID NO: 1038 - DNA, 27 bp, Artificial Sequence
  Description of Artificial Sequence: Synthetic oligonucleotide
  Description of Combined DNA/RNA Molecule: Synthetic oligonucleotide
aatgcacctttttatttatttattttt

SEQ ID NO: 1039 - DNA, 27 bp, Artificial Sequence
  Description of Artificial Sequence: Synthetic oligonucleotide
  Description of Combined DNA/RNA Molecule: Synthetic oligonucleotide
tgcacctttttatttatttatttttgg

SEQ ID NO: 1040 - DNA, 27 bp, Artificial Sequence
  Description of Artificial Sequence: Synthetic oligonucleotide
  Description of Combined DNA/RNA Molecule: Synthetic oligonucleotide
cacctttttatttatttatttttggct

SEQ ID NO: 1041 - DNA, 27 bp, Artificial Sequence
  Description of Artificial Sequence: Synthetic oligonucleotide
  Description of Combined DNA/RNA Molecule: Synthetic oligonucleotide
cctttttatttatttatttttggctag

SEQ ID NO: 1042 - DNA, 27 bp, Artificial Sequence
  Description of Artificial Sequence: Synthetic oligonucleotide
  Description of Combined DNA/RNA Molecule: Synthetic oligonucleotide
tttttatttatttatttttggctaggg

SEQ ID NO: 1043 - DNA, 27 bp, Artificial Sequence
  Description of Artificial Sequence: Synthetic oligonucleotide
  Description of Combined DNA/RNA Molecule: Synthetic oligonucleotide
ctttttcgaattatttttaagaagatg

SEQ ID NO: 1044 - DNA, 27 bp, Artificial Sequence
  Description of Artificial Sequence: Synthetic oligonucleotide
  Description of Combined DNA/RNA Molecule: Synthetic oligonucleotide
gccaatataatttttgtaagaaggcag

SEQ ID NO: 1045 - DNA, 27 bp, Artificial Sequence
  Description of Artificial Sequence: Synthetic oligonucleotide
  Description of Combined DNA/RNA Molecule: Synthetic oligonucleotide
ttcatcatgatcataggcagttgaaaa

SEQ ID NO: 1046 - DNA, 27 bp, Artificial Sequence
  Description of Artificial Sequence: Synthetic oligonucleotide
  Description of Combined DNA/RNA Molecule: Synthetic oligonucleotide
catcatgatcataggcagttgaaaaat

SEQ ID NO: 1047 - DNA, 27 bp, Artificial Sequence
  Description of Artificial Sequence: Synthetic oligonucleotide
  Description of Combined DNA/RNA Molecule: Synthetic oligonucleotide
tcatgatcataggcagttgaaaaattt

SEQ ID NO: 1048 - DNA, 27 bp, Artificial Sequence
  Description of Artificial Sequence: Synthetic oligonucleotide
  Description of Combined DNA/RNA Molecule: Synthetic oligonucleotide
atgatcataggcagttgaaaaattttt

SEQ ID NO: 1049 - DNA, 27 bp, Artificial Sequence
  Description of Artificial Sequence: Synthetic oligonucleotide
  Description of Combined DNA/RNA Molecule: Synthetic oligonucleotide
agttgaaaaatttttacaccttttttt

SEQ ID NO: 1050 - DNA, 27 bp, Artificial Sequence
  Description of Artificial Sequence: Synthetic oligonucleotide
  Description of Combined DNA/RNA Molecule: Synthetic oligonucleotide
ccttttttttcacattttacataaata

SEQ ID NO: 1051 - DNA, 27 bp, Artificial Sequence
  Description of Artificial Sequence: Synthetic oligonucleotide
  Description of Combined DNA/RNA Molecule: Synthetic oligonucleotide
gtggtagccacaattgcacaatatatt

SEQ ID NO: 1052 - DNA, 27 bp, Artificial Sequence
  Description of Artificial Sequence: Synthetic oligonucleotide
  Description of Combined DNA/RNA Molecule: Synthetic oligonucleotide
ggtagccacaattgcacaatatatttt

SEQ ID NO: 1053 - DNA, 27 bp, Artificial Sequence
  Description of Artificial Sequence: Synthetic oligonucleotide
  Description of Combined DNA/RNA Molecule: Synthetic oligonucleotide
tagccacaattgcacaatatattttct

SEQ ID NO: 1054 - DNA, 27 bp, Artificial Sequence
  Description of Artificial Sequence: Synthetic oligonucleotide
  Description of Combined DNA/RNA Molecule: Synthetic oligonucleotide
gccacaattgcacaatatattttctta

SEQ ID NO: 1055 - DNA, 27 bp, Artificial Sequence
  Description of Artificial Sequence: Synthetic oligonucleotide
  Description of Combined DNA/RNA Molecule: Synthetic oligonucleotide
cacaattgcacaatatattttcttaaa

SEQ ID NO: 1056 - DNA, 27 bp, Artificial Sequence
  Description of Artificial Sequence: Synthetic oligonucleotide
  Description of Combined DNA/RNA Molecule: Synthetic oligonucleotide
caattgcacaatatattttcttaaaaa

SEQ ID NO: 1057 - DNA, 27 bp, Artificial Sequence
  Description of Artificial Sequence: Synthetic oligonucleotide
  Description of Combined DNA/RNA Molecule: Synthetic oligonucleotide
cacaatatattttcttaaaaaatacca

SEQ ID NO: 1058 - DNA, 27 bp, Artificial Sequence
  Description of Artificial Sequence: Synthetic oligonucleotide
  Description of Combined DNA/RNA Molecule: Synthetic oligonucleotide
gcgtttataaaactagtttttaagaag

SEQ ID NO: 1059 - DNA, 27 bp, Artificial Sequence
  Description of Artificial Sequence: Synthetic oligonucleotide
  Description of Combined DNA/RNA Molecule: Synthetic oligonucleotide
cgtttataaaactagtttttaagaaga

SEQ ID NO: 1060 - DNA, 27 bp, Artificial Sequence
  Description of Artificial Sequence: Synthetic oligonucleotide
  Description of Combined DNA/RNA Molecule: Synthetic oligonucleotide
tttataaaactagtttttaagaagaaa

SEQ ID NO: 1061 - DNA, 27 bp, Artificial Sequence
  Description of Artificial Sequence: Synthetic oligonucleotide
  Description of Combined DNA/RNA Molecule: Synthetic oligonucleotide
tataaaactagtttttaagaagaaatt

SEQ ID NO: 1062 - DNA, 27 bp, Artificial Sequence
  Description of Artificial Sequence: Synthetic oligonucleotide
  Description of Combined DNA/RNA Molecule: Synthetic oligonucleotide
ttttaagaagaaattttttttggccta

SEQ ID NO: 1063 - DNA, 27 bp, Artificial Sequence
  Description of Artificial Sequence: Synthetic oligonucleotide
  Description of Combined DNA/RNA Molecule: Synthetic oligonucleotide
gaagaaattttttttggcctatgaaat

SEQ ID NO: 1064 - DNA, 27 bp, Artificial Sequence
  Description of Artificial Sequence: Synthetic oligonucleotide
  Description of Combined DNA/RNA Molecule: Synthetic oligonucleotide
agaaattttttttggcctatgaaattg

SEQ ID NO: 1065 - DNA, 27 bp, Artificial Sequence
  Description of Artificial Sequence: Synthetic oligonucleotide
  Description of Combined DNA/RNA Molecule: Synthetic oligonucleotide
cctatgaaattgttaaacctggaacat

SEQ ID NO: 1066 - DNA, 27 bp, Artificial Sequence
  Description of Artificial Sequence: Synthetic oligonucleotide
  Description of Combined DNA/RNA Molecule: Synthetic oligonucleotide
acattgttaatcatataataatgattc

SEQ ID NO: 1067 - DNA, 27 bp, Artificial Sequence
  Description of Artificial Sequence: Synthetic oligonucleotide
  Description of Combined DNA/RNA Molecule: Synthetic oligonucleotide
gtatggtttattatttaaatgggtaaa

SEQ ID NO: 1068 - DNA, 27 bp, Artificial Sequence
  Description of Artificial Sequence: Synthetic oligonucleotide
  Description of Combined DNA/RNA Molecule: Synthetic oligonucleotide
aatgggtaaagccatttacataatata

SEQ ID NO: 1069 - DNA, 27 bp, Artificial Sequence
  Description of Artificial Sequence: Synthetic oligonucleotide
  Description of Combined DNA/RNA Molecule: Synthetic oligonucleotide
ccatttacataatatagaaagatatgc

SEQ ID NO: 1070 - DNA, 27 bp, Artificial Sequence
  Description of Artificial Sequence: Synthetic oligonucleotide
  Description of Combined DNA/RNA Molecule: Synthetic oligonucleotide
agaaggtatgtggcatttatttggata

SEQ ID NO: 1071 - DNA, 27 bp, Artificial Sequence
  Description of Artificial Sequence: Synthetic oligonucleotide
  Description of Combined DNA/RNA Molecule: Synthetic oligonucleotide
aaggtatgtggcatttatttggataaa

SEQ ID NO: 1072 - DNA, 27 bp, Artificial Sequence
  Description of Artificial Sequence: Synthetic oligonucleotide
  Description of Combined DNA/RNA Molecule: Synthetic oligonucleotide
ggtatgtggcatttatttggataaaat

SEQ ID NO: 1073 - DNA, 27 bp, Artificial Sequence
  Description of Artificial Sequence: Synthetic oligonucleotide
  Description of Combined DNA/RNA Molecule: Synthetic oligonucleotide
tatgtggcatttatttggataaaattc

SEQ ID NO: 1074 - DNA, 27 bp, Artificial Sequence
  Description of Artificial Sequence: Synthetic oligonucleotide
  Description of Combined DNA/RNA Molecule: Synthetic oligonucleotide
tgtggcatttatttggataaaattctc

SEQ ID NO: 1075 - DNA, 27 bp, Artificial Sequence
  Description of Artificial Sequence: Synthetic oligonucleotide
  Description of Combined DNA/RNA Molecule: Synthetic oligonucleotide
tggcatttatttggataaaattctcaa

SEQ ID NO: 1076 - DNA, 27 bp, Artificial Sequence
  Description of Artificial Sequence: Synthetic oligonucleotide
  Description of Combined DNA/RNA Molecule: Synthetic oligonucleotide
gcatttatttggataaaattctcaatt

SEQ ID NO: 1077 - DNA, 27 bp, Artificial Sequence
  Description of Artificial Sequence: Synthetic oligonucleotide
  Description of Combined DNA/RNA Molecule: Synthetic oligonucleotide
atttatttggataaaattctcaattca

SEQ ID NO: 1078 - DNA, 27 bp, Artificial Sequence
  Description of Artificial Sequence: Synthetic oligonucleotide
  Description of Combined DNA/RNA Molecule: Synthetic oligonucleotide
ttatttggataaaattctcaattcaga

SEQ ID NO: 1079 - DNA, 27 bp, Artificial Sequence
  Description of Artificial Sequence: Synthetic oligonucleotide
  Description of Combined DNA/RNA Molecule: Synthetic oligonucleotide
ttatttggataaaattctcaattcaga

SEQ ID NO: 1080 - DNA, 27 bp, Artificial Sequence
  Description of Artificial Sequence: Synthetic oligonucleotide
  Description of Combined DNA/RNA Molecule: Synthetic oligonucleotide
atttggataaaattctcaattcagaga

SEQ ID NO: 1081 - DNA, 27 bp, Artificial Sequence
  Description of Artificial Sequence: Synthetic oligonucleotide
  Description of Combined DNA/RNA Molecule: Synthetic oligonucleotide
ttggataaaattctcaattcagagaaa

SEQ ID NO: 1082 - DNA, 27 bp, Artificial Sequence
  Description of Artificial Sequence: Synthetic oligonucleotide
  Description of Combined DNA/RNA Molecule: Synthetic oligonucleotide
ggataaaattctcaattcagagaaatc

SEQ ID NO: 1083 - DNA, 27 bp, Artificial Sequence
  Description of Artificial Sequence: Synthetic oligonucleotide
  Description of Combined DNA/RNA Molecule: Synthetic oligonucleotide
ataaaattctcaattcagagaaatcat

SEQ ID NO: 1084 - DNA, 27 bp, Artificial Sequence
  Description of Artificial Sequence: Synthetic oligonucleotide
  Description of Combined DNA/RNA Molecule: Synthetic oligonucleotide
catctgatgtttctatagtcactttgc

SEQ ID NO: 1085 - DNA, 27 bp, Artificial Sequence
  Description of Artificial Sequence: Synthetic oligonucleotide
  Description of Combined DNA/RNA Molecule: Synthetic oligonucleotide
atgtttctatagtcactttgccagctc

SEQ ID NO: 1086 - DNA, 27 bp, Artificial Sequence
  Description of Artificial Sequence: Synthetic oligonucleotide
  Description of Combined DNA/RNA Molecule: Synthetic oligonucleotide
tctatagtcactttgccagctcaaaag

SEQ ID NO: 1087 - DNA, 27 bp, Artificial Sequence
  Description of Artificial Sequence: Synthetic oligonucleotide
  Description of Combined DNA/RNA Molecule: Synthetic oligonucleotide
ctcaaaagaaaacaataccctatgtag

SEQ ID NO: 1088 - DNA, 27 bp, Artificial Sequence
  Description of Artificial Sequence: Synthetic oligonucleotide
  Description of Combined DNA/RNA Molecule: Synthetic oligonucleotide
tgttctgcctaccctgttggtataaag

SEQ ID NO: 1089 - DNA, 27 bp, Artificial Sequence
  Description of Artificial Sequence: Synthetic oligonucleotide
  Description of Combined DNA/RNA Molecule: Synthetic oligonucleotide
ttctgcctaccctgttggtataaagat

SEQ ID NO: 1090 - DNA, 27 bp, Artificial Sequence
  Description of Artificial Sequence: Synthetic oligonucleotide
  Description of Combined DNA/RNA Molecule: Synthetic oligonucleotide
tctgcctaccctgttggtataaagata

SEQ ID NO: 1091 - DNA, 27 bp, Artificial Sequence
  Description of Artificial Sequence: Synthetic oligonucleotide
  Description of Combined DNA/RNA Molecule: Synthetic oligonucleotide
tgcctaccctgttggtataaagatatt

SEQ ID NO: 1092 - DNA, 27 bp, Artificial Sequence
  Description of Artificial Sequence: Synthetic oligonucleotide
  Description of Combined DNA/RNA Molecule: Synthetic oligonucleotide
gcctaccctgttggtataaagatattt

SEQ ID NO: 1093 - DNA, 27 bp, Artificial Sequence
  Description of Artificial Sequence: Synthetic oligonucleotide
  Description of Combined DNA/RNA Molecule: Synthetic oligonucleotide
ccctgttggtataaagatattttgagc

SEQ ID NO: 1094 - DNA, 27 bp, Artificial Sequence
  Description of Artificial Sequence: Synthetic oligonucleotide
  Description of Combined DNA/RNA Molecule: Synthetic oligonucleotide
tgttggtataaagatattttgagcaga

SEQ ID NO: 1095 - DNA, 27 bp, Artificial Sequence
  Description of Artificial Sequence: Synthetic oligonucleotide
  Description of Combined DNA/RNA Molecule: Synthetic oligonucleotide
caagaaaaaaaaaatcatgcattctta

SEQ ID NO: 1096 - DNA, 27 bp, Artificial Sequence
  Description of Artificial Sequence: Synthetic oligonucleotide
  Description of Combined DNA/RNA Molecule: Synthetic oligonucleotide
agtatgttaatttgctcaaaatacaat

SEQ ID NO: 1097 - DNA, 27 bp, Artificial Sequence
  Description of Artificial Sequence: Synthetic oligonucleotide
  Description of Combined DNA/RNA Molecule: Synthetic oligonucleotide
gattttatgcactttgtcgctattaac

SEQ ID NO: 1098 - DNA, 27 bp, Artificial Sequence
  Description of Artificial Sequence: Synthetic oligonucleotide
  Description of Combined DNA/RNA Molecule: Synthetic oligonucleotide
ttttatgcactttgtcgctattaacat

SEQ ID NO: 1099 - DNA, 27 bp, Artificial Sequence
  Description of Artificial Sequence: Synthetic oligonucleotide
  Description of Combined DNA/RNA Molecule: Synthetic oligonucleotide
ttatgcactttgtcgctattaacatcc

SEQ ID NO: 1100 - DNA, 27 bp, Artificial Sequence
  Description of Artificial Sequence: Synthetic oligonucleotide
  Description of Combined DNA/RNA Molecule: Synthetic oligonucleotide
atgcactttgtcgctattaacatcctt

SEQ ID NO: 1101 - DNA, 27 bp, Artificial Sequence
  Description of Artificial Sequence: Synthetic oligonucleotide
  Description of Combined DNA/RNA Molecule: Synthetic oligonucleotide
gcactttgtcgctattaacatcctttt

SEQ ID NO: 1102 - DNA, 27 bp, Artificial Sequence
  Description of Artificial Sequence: Synthetic oligonucleotide
  Description of Combined DNA/RNA Molecule: Synthetic oligonucleotide
actttgtcgctattaacatcctttttt

SEQ ID NO: 1103 - DNA, 27 bp, Artificial Sequence
  Description of Artificial Sequence: Synthetic oligonucleotide
  Description of Combined DNA/RNA Molecule: Synthetic oligonucleotide
tttgtcgctattaacatcctttttttc

SEQ ID NO: 1104 - DNA, 27 bp, Artificial Sequence
  Description of Artificial Sequence: Synthetic oligonucleotide
  Description of Combined DNA/RNA Molecule: Synthetic oligonucleotide
tgtcgctattaacatcctttttttcat

SEQ ID NO: 1105 - DNA, 27 bp, Artificial Sequence
  Description of Artificial Sequence: Synthetic oligonucleotide
  Description of Combined DNA/RNA Molecule: Synthetic oligonucleotide
tcgctattaacatcctttttttcatgt

SEQ ID NO: 1106 - DNA, 27 bp, Artificial Sequence
  Description of Artificial Sequence: Synthetic oligonucleotide
  Description of Combined DNA/RNA Molecule: Synthetic oligonucleotide
ctattaacatcctttttttcatgtaga

SEQ ID NO: 1107 - DNA, 27 bp, Artificial Sequence
  Description of Artificial Sequence: Synthetic oligonucleotide
  Description of Combined DNA/RNA Molecule: Synthetic oligonucleotide
ttgagtaattttagaagcattatttta

SEQ ID NO: 1108 - DNA, 27 bp, Artificial Sequence
  Description of Artificial Sequence: Synthetic oligonucleotide
  Description of Combined DNA/RNA Molecule: Synthetic oligonucleotide
gagtaattttagaagcattattttagg

SEQ ID NO: 1109 - DNA, 27 bp, Artificial Sequence
  Description of Artificial Sequence: Synthetic oligonucleotide
  Description of Combined DNA/RNA Molecule: Synthetic oligonucleotide
gtaattttagaagcattattttaggaa

SEQ ID NO: 1110 - DNA, 27 bp, Artificial Sequence
  Description of Artificial Sequence: Synthetic oligonucleotide
  Description of Combined DNA/RNA Molecule: Synthetic oligonucleotide
aattttagaagcattattttaggaata

SEQ ID NO: 1111 - DNA, 27 bp, Artificial Sequence
  Description of Artificial Sequence: Synthetic oligonucleotide
  Description of Combined DNA/RNA Molecule: Synthetic oligonucleotide
ttttagaagcattattttaggaatata

SEQ ID NO: 1112 - DNA, 27 bp, Artificial Sequence
  Description of Artificial Sequence: Synthetic oligonucleotide
  Description of Combined DNA/RNA Molecule: Synthetic oligonucleotide
ttagaagcattattttaggaatatata

SEQ ID NO: 1113 - DNA, 27 bp, Artificial Sequence
  Description of Artificial Sequence: Synthetic oligonucleotide
  Description of Combined DNA/RNA Molecule: Synthetic oligonucleotide
agaagcattattttaggaatatatagt

SEQ ID NO: 1114 - DNA, 27 bp, Artificial Sequence
  Description of Artificial Sequence: Synthetic oligonucleotide
  Description of Combined DNA/RNA Molecule: Synthetic oligonucleotide
aagcattattttaggaatatatagttg

SEQ ID NO: 1115 - DNA, 27 bp, Artificial Sequence
  Description of Artificial Sequence: Synthetic oligonucleotide
  Description of Combined DNA/RNA Molecule: Synthetic oligonucleotide
agtaaatatcttgttttttctatgtac

SEQ ID NO: 1116 - DNA, 27 bp, Artificial Sequence
  Description of Artificial Sequence: Synthetic oligonucleotide
  Description of Combined DNA/RNA Molecule: Synthetic oligonucleotide
ctatgtacattgtacaaatttttcatt

SEQ ID NO: 1117 - DNA, 27 bp, Artificial Sequence
  Description of Artificial Sequence: Synthetic oligonucleotide
  Description of Combined DNA/RNA Molecule: Synthetic oligonucleotide
ttttcattccttttgctctttgtggtt

SEQ ID NO: 1118 - DNA, 27 bp, Artificial Sequence
  Description of Artificial Sequence: Synthetic oligonucleotide
  Description of Combined DNA/RNA Molecule: Synthetic oligonucleotide
tttcattccttttgctctttgtggttg

SEQ ID NO: 1119 - DNA, 27 bp, Artificial Sequence
  Description of Artificial Sequence: Synthetic oligonucleotide
  Description of Combined DNA/RNA Molecule: Synthetic oligonucleotide
ttcattccttttgctctttgtggttgg

SEQ ID NO: 1120 - DNA, 27 bp, Artificial Sequence
  Description of Artificial Sequence: Synthetic oligonucleotide
  Description of Combined DNA/RNA Molecule: Synthetic oligonucleotide
cattccttttgctctttgtggttggat

SEQ ID NO: 1121 - DNA, 27 bp, Artificial Sequence
  Description of Artificial Sequence: Synthetic oligonucleotide
  Description of Combined DNA/RNA Molecule: Synthetic oligonucleotide
attccttttgctctttgtggttggatc

SEQ ID NO: 1122 - DNA, 27 bp, Artificial Sequence
  Description of Artificial Sequence: Synthetic oligonucleotide
  Description of Combined DNA/RNA Molecule: Synthetic oligonucleotide
ttccttttgctctttgtggttggatct

SEQ ID NO: 1123 - DNA, 27 bp, Artificial Sequence
  Description of Artificial Sequence: Synthetic oligonucleotide
  Description of Combined DNA/RNA Molecule: Synthetic oligonucleotide
tccttttgctctttgtggttggatcta

SEQ ID NO: 1124 - DNA, 27 bp, Artificial Sequence
  Description of Artificial Sequence: Synthetic oligonucleotide
  Description of Combined DNA/RNA Molecule: Synthetic oligonucleotide
ccttttgctctttgtggttggatctaa

SEQ ID NO: 1125 - DNA, 27 bp, Artificial Sequence
  Description of Artificial Sequence: Synthetic oligonucleotide
  Description of Combined DNA/RNA Molecule: Synthetic oligonucleotide
cttttgctctttgtggttggatctaac

SEQ ID NO: 1126 - DNA, 27 bp, Artificial Sequence
  Description of Artificial Sequence: Synthetic oligonucleotide
  Description of Combined DNA/RNA Molecule: Synthetic oligonucleotide
ttttgctctttgtggttggatctaaca

SEQ ID NO: 1127 - DNA, 27 bp, Artificial Sequence
  Description of Artificial Sequence: Synthetic oligonucleotide
  Description of Combined DNA/RNA Molecule: Synthetic oligonucleotide
tttgctctttgtggttggatctaacac

SEQ ID NO: 1128 - DNA, 27 bp, Artificial Sequence
  Description of Artificial Sequence: Synthetic oligonucleotide
  Description of Combined DNA/RNA Molecule: Synthetic oligonucleotide
tgctctttgtggttggatctaacacta

SEQ ID NO: 1129 - DNA, 27 bp, Artificial Sequence
  Description of Artificial Sequence: Synthetic oligonucleotide
  Description of Combined DNA/RNA Molecule: Synthetic oligonucleotide
acatcaaataaacatcttctgtggacc

SEQ ID NO: 1130 - DNA, 27 bp, Artificial Sequence
  Description of Artificial Sequence: Synthetic oligonucleotide
  Description of Combined DNA/RNA Molecule: Synthetic oligonucleotide
atcaaataaacatcttctgtggaccag

SEQ ID NO: 1131 - DNA, 27 bp, Artificial Sequence
  Description of Artificial Sequence: Synthetic oligonucleotide
  Description of Combined DNA/RNA Molecule: Synthetic oligonucleotide
caaataaacatcttctgtggaccaggc

SEQ ID NO: 1132 - DNA, 27 bp, Artificial Sequence
  Description of Artificial Sequence: Synthetic oligonucleotide
  Description of Combined DNA/RNA Molecule: Synthetic oligonucleotide
aataaacatcttctgtggaccaggcaa

SEQ ID NO: 1133 - DNA, 27 bp, Artificial Sequence
  Description of Artificial Sequence: Synthetic oligonucleotide
  Description of Combined DNA/RNA Molecule: Synthetic oligonucleotide
taaacatcttctgtggaccaggcaaaa

SEQ ID NO: 1134 - DNA, 27 bp, Artificial Sequence
  Description of Artificial Sequence: Synthetic oligonucleotide
  Description of Combined DNA/RNA Molecule: Synthetic oligonucleotide
aacatcttctgtggaccaggcaaaaaa

SEQ ID NO: 1135 - RNA, 25 nt, Artificial Sequence
  Description of Artificial Sequence: Synthetic oligonucleotide
  Description of Combined DNA/RNA Molecule: Synthetic oligonucleotide
gaagacaucgcggggaccgauucac

SEQ ID NO: 1136 - RNA, 25 nt, Artificial Sequence
  Description of Artificial Sequence: Synthetic oligonucleotide
  Description of Combined DNA/RNA Molecule: Synthetic oligonucleotide
guucugaacgucgaaaagaaaaguc

SEQ ID NO: 1137 - RNA, 25 nt, Artificial Sequence
  Description of Artificial Sequence: Synthetic oligonucleotide
  Description of Combined DNA/RNA Molecule: Synthetic oligonucleotide
ugaaguuuuuuaugagcuugcucau

SEQ ID NO: 1138 - RNA, 25 nt, Artificial Sequence
  Description of Artificial Sequence: Synthetic oligonucleotide
  Description of Combined DNA/RNA Molecule: Synthetic oligonucleotide
guuuuuuaugagcuugcucaucagu

SEQ ID NO: 1139 - RNA, 25 nt, Artificial Sequence
  Description of Artificial Sequence: Synthetic oligonucleotide
  Description of Combined DNA/RNA Molecule: Synthetic oligonucleotide
ugaauugcuuuuauuugaaagccuu

SEQ ID NO: 1140 - RNA, 25 nt, Artificial Sequence
  Description of Artificial Sequence: Synthetic oligonucleotide
  Description of Combined DNA/RNA Molecule: Synthetic oligonucleotide
gccuuggaugguuuuguuaugguuc

SEQ ID NO: 1141 - RNA, 25 nt, Artificial Sequence
  Description of Artificial Sequence: Synthetic oligonucleotide
  Description of Combined DNA/RNA Molecule: Synthetic oligonucleotide
cuuggaugguuuuguuaugguucuc

SEQ ID NO: 1142 - RNA, 25 nt, Artificial Sequence
  Description of Artificial Sequence: Synthetic oligonucleotide
  Description of Combined DNA/RNA Molecule: Synthetic oligonucleotide
uggaugguuuuguuaugguucucac

SEQ ID NO: 1143 - RNA, 25 nt, Artificial Sequence
  Description of Artificial Sequence: Synthetic oligonucleotide
  Description of Combined DNA/RNA Molecule: Synthetic oligonucleotide
gaugguuuuguuaugguucucacag

SEQ ID NO: 1144 - RNA, 25 nt, Artificial Sequence
  Description of Artificial Sequence: Synthetic oligonucleotide
  Description of Combined DNA/RNA Molecule: Synthetic oligonucleotide
auuuacauuucugauaaugugaaca

SEQ ID NO: 1145 - RNA, 25 nt, Artificial Sequence
  Description of Artificial Sequence: Synthetic oligonucleotide
  Description of Combined DNA/RNA Molecule: Synthetic oligonucleotide
guuugauuuuacucauccaugugac

SEQ ID NO: 1146 - RNA, 25 nt, Artificial Sequence
  Description of Artificial Sequence: Synthetic oligonucleotide
  Description of Combined DNA/RNA Molecule: Synthetic oligonucleotide
aguaaccaaccucaguguggguaua

SEQ ID NO: 1147 - RNA, 25 nt, Artificial Sequence
  Description of Artificial Sequence: Synthetic oligonucleotide
  Description of Combined DNA/RNA Molecule: Synthetic oligonucleotide
ugcugauuugugaacccauuccuca

SEQ ID NO: 1148 - RNA, 25 nt, Artificial Sequence
  Description of Artificial Sequence: Synthetic oligonucleotide
  Description of Combined DNA/RNA Molecule: Synthetic oligonucleotide
uuaucaugcuuuggacucugaucau

SEQ ID NO: 1149 - RNA, 25 nt, Artificial Sequence
  Description of Artificial Sequence: Synthetic oligonucleotide
  Description of Combined DNA/RNA Molecule: Synthetic oligonucleotide
ugcuuuggacucugaucaucugacc

SEQ ID NO: 1150 - RNA, 25 nt, Artificial Sequence
  Description of Artificial Sequence: Synthetic oligonucleotide
  Description of Combined DNA/RNA Molecule: Synthetic oligonucleotide
uuuggacucugaucaucugaccaaa

SEQ ID NO: 1151 - RNA, 25 nt, Artificial Sequence
  Description of Artificial Sequence: Synthetic oligonucleotide
  Description of Combined DNA/RNA Molecule: Synthetic oligonucleotide
caggaugcuugccaaaagaggugga

SEQ ID NO: 1152 - RNA, 25 nt, Artificial Sequence
  Description of Artificial Sequence: Synthetic oligonucleotide
  Description of Combined DNA/RNA Molecule: Synthetic oligonucleotide
auaugucuggguugaaacucaagca

SEQ ID NO: 1153 - RNA, 25 nt, Artificial Sequence
  Description of Artificial Sequence: Synthetic oligonucleotide
  Description of Combined DNA/RNA Molecule: Synthetic oligonucleotide
augucuggguugaaacucaagcaac

SEQ ID NO: 1154 - RNA, 25 nt, Artificial Sequence
  Description of Artificial Sequence: Synthetic oligonucleotide
  Description of Combined DNA/RNA Molecule: Synthetic oligonucleotide
guugaaacucaagcaacugucauau

SEQ ID NO: 1155 - RNA, 25 nt, Artificial Sequence
  Description of Artificial Sequence: Synthetic oligonucleotide
  Description of Combined DNA/RNA Molecule: Synthetic oligonucleotide
ugaaacucaagcaacugucauauau

SEQ ID NO: 1156 - RNA, 25 nt, Artificial Sequence
  Description of Artificial Sequence: Synthetic oligonucleotide
  Description of Combined DNA/RNA Molecule: Synthetic oligonucleotide
cacgacuugauuuucucccuucaac

SEQ ID NO: 1157 - RNA, 25 nt, Artificial Sequence
  Description of Artificial Sequence: Synthetic oligonucleotide
  Description of Combined DNA/RNA Molecule: Synthetic oligonucleotide
uugauuuucucccuucaacaaacag

SEQ ID NO: 1158 - RNA, 25 nt, Artificial Sequence
  Description of Artificial Sequence: Synthetic oligonucleotide
  Description of Combined DNA/RNA Molecule: Synthetic oligonucleotide
gauuuucucccuucaacaaacagaa

SEQ ID NO: 1159 - RNA, 25 nt, Artificial Sequence
  Description of Artificial Sequence: Synthetic oligonucleotide
  Description of Combined DNA/RNA Molecule: Synthetic oligonucleotide
uucucccuucaacaaacagaaugug

SEQ ID NO: 1160 - RNA, 25 nt, Artificial Sequence
  Description of Artificial Sequence: Synthetic oligonucleotide
  Description of Combined DNA/RNA Molecule: Synthetic oligonucleotide
caaucauaucuuuagauuuuggcag

SEQ ID NO: 1161 - RNA, 25 nt, Artificial Sequence
  Description of Artificial Sequence: Synthetic oligonucleotide
  Description of Combined DNA/RNA Molecule: Synthetic oligonucleotide
gaaguugcauuaaaauuagaaccaa

SEQ ID NO: 1162 - RNA, 25 nt, Artificial Sequence
  Description of Artificial Sequence: Synthetic oligonucleotide
  Description of Combined DNA/RNA Molecule: Synthetic oligonucleotide
aagcacuagacaaaguucaccugag

SEQ ID NO: 1163 - RNA, 25 nt, Artificial Sequence
  Description of Artificial Sequence: Synthetic oligonucleotide
  Description of Combined DNA/RNA Molecule: Synthetic oligonucleotide
acuagacaaaguucaccugagccua

SEQ ID NO: 1164 - RNA, 25 nt, Artificial Sequence
  Description of Artificial Sequence: Synthetic oligonucleotide
  Description of Combined DNA/RNA Molecule: Synthetic oligonucleotide
uagacaaaguucaccugagccuaau

SEQ ID NO: 1165 - RNA, 25 nt, Artificial Sequence
  Description of Artificial Sequence: Synthetic oligonucleotide
  Description of Combined DNA/RNA Molecule: Synthetic oligonucleotide
guagaaaaacuuuuugcugaagaca

SEQ ID NO: 1166 - RNA, 25 nt, Artificial Sequence
  Description of Artificial Sequence: Synthetic oligonucleotide
  Description of Combined DNA/RNA Molecule: Synthetic oligonucleotide
caaaagacaauuauuuuaauacccu

SEQ ID NO: 1167 - RNA, 25 nt, Artificial Sequence
  Description of Artificial Sequence: Synthetic oligonucleotide
  Description of Combined DNA/RNA Molecule: Synthetic oligonucleotide
gauuaccacagcugaccaguuauga

SEQ ID NO: 1168 - RNA, 25 nt, Artificial Sequence
  Description of Artificial Sequence: Synthetic oligonucleotide
  Description of Combined DNA/RNA Molecule: Synthetic oligonucleotide
cuuuggaucaaguuaacugagcuuu

SEQ ID NO: 1169 - RNA, 25 nt, Artificial Sequence
  Description of Artificial Sequence: Synthetic oligonucleotide
  Description of Combined DNA/RNA Molecule: Synthetic oligonucleotide
cauuccuuuuuuuggacacuggugg

SEQ ID NO: 1170 - RNA, 25 nt, Artificial Sequence
  Description of Artificial Sequence: Synthetic oligonucleotide
  Description of Combined DNA/RNA Molecule: Synthetic oligonucleotide
uuuuuggacacugguggcucauuac

SEQ ID NO: 1171 - RNA, 25 nt, Artificial Sequence
  Description of Artificial Sequence: Synthetic oligonucleotide
  Description of Combined DNA/RNA Molecule: Synthetic oligonucleotide
gcagucuauuuauauuuucuacauc

SEQ ID NO: 1172 - RNA, 25 nt, Artificial Sequence
  Description of Artificial Sequence: Synthetic oligonucleotide
  Description of Combined DNA/RNA Molecule: Synthetic oligonucleotide
agucuauuuauauuuucuacaucua

SEQ ID NO: 1173 - RNA, 25 nt, Artificial Sequence
  Description of Artificial Sequence: Synthetic oligonucleotide
  Description of Combined DNA/RNA Molecule: Synthetic oligonucleotide
auuuauauuuucuacaucuaauuuu

SEQ ID NO: 1174 - RNA, 25 nt, Artificial Sequence
  Description of Artificial Sequence: Synthetic oligonucleotide
  Description of Combined DNA/RNA Molecule: Synthetic oligonucleotide
uaauuuacauuaaugcucuuuuuua

SEQ ID NO: 1175 - RNA, 25 nt, Artificial Sequence
  Description of Artificial Sequence: Synthetic oligonucleotide
  Description of Combined DNA/RNA Molecule: Synthetic oligonucleotide
uuuaaugcuggaucacagacagcuc

SEQ ID NO: 1176 - RNA, 25 nt, Artificial Sequence
  Description of Artificial Sequence: Synthetic oligonucleotide
  Description of Combined DNA/RNA Molecule: Synthetic oligonucleotide
cucauuuucucaguuuuuugguauu

SEQ ID NO: 1177 - RNA, 25 nt, Artificial Sequence
  Description of Artificial Sequence: Synthetic oligonucleotide
  Description of Combined DNA/RNA Molecule: Synthetic oligonucleotide
uuuuuuuucacauuuuacauaaaua

SEQ ID NO: 1178 - RNA, 25 nt, Artificial Sequence
  Description of Artificial Sequence: Synthetic oligonucleotide
  Description of Combined DNA/RNA Molecule: Synthetic oligonucleotide
cacaauugcacaauauauuuucuua

SEQ ID NO: 1179 - RNA, 25 nt, Artificial Sequence
  Description of Artificial Sequence: Synthetic oligonucleotide
  Description of Combined DNA/RNA Molecule: Synthetic oligonucleotide
caauugcacaauauauuuucuuaaa

SEQ ID NO: 1180 - RNA, 25 nt, Artificial Sequence
  Description of Artificial Sequence: Synthetic oligonucleotide
  Description of Combined DNA/RNA Molecule: Synthetic oligonucleotide
caauauauuuucuuaaaaaauacca

SEQ ID NO: 1181 - RNA, 25 nt, Artificial Sequence
  Description of Artificial Sequence: Synthetic oligonucleotide
  Description of Combined DNA/RNA Molecule: Synthetic oligonucleotide
uaaaacuaguuuuuaagaagaaauu

SEQ ID NO: 1182 - RNA, 25 nt, Artificial Sequence
  Description of Artificial Sequence: Synthetic oligonucleotide
  Description of Combined DNA/RNA Molecule: Synthetic oligonucleotide
agaaauuuuuuuuggccuaugaaau

SEQ ID NO: 1183 - RNA, 25 nt, Artificial Sequence
  Description of Artificial Sequence: Synthetic oligonucleotide
  Description of Combined DNA/RNA Molecule: Synthetic oligonucleotide
aaauuuuuuuuggccuaugaaauug

SEQ ID NO: 1184 - RNA, 25 nt, Artificial Sequence
  Description of Artificial Sequence: Synthetic oligonucleotide
  Description of Combined DNA/RNA Molecule: Synthetic oligonucleotide
uguggcauuuauuuggauaaaauuc

SEQ ID NO: 1185 - RNA, 25 nt, Artificial Sequence
  Description of Artificial Sequence: Synthetic oligonucleotide
  Description of Combined DNA/RNA Molecule: Synthetic oligonucleotide
aaaauucucaauucagagaaaucau

SEQ ID NO: 1186 - RNA, 25 nt, Artificial Sequence
  Description of Artificial Sequence: Synthetic oligonucleotide
  Description of Combined DNA/RNA Molecule: Synthetic oligonucleotide
guuucuauagucacuuugccagcuc

SEQ ID NO: 1187 - RNA, 25 nt, Artificial Sequence
  Description of Artificial Sequence: Synthetic oligonucleotide
  Description of Combined DNA/RNA Molecule: Synthetic oligonucleotide
caaaagaaaacaauacccuauguag

SEQ ID NO: 1188 - RNA, 25 nt, Artificial Sequence
  Description of Artificial Sequence: Synthetic oligonucleotide
  Description of Combined DNA/RNA Molecule: Synthetic oligonucleotide
uucugccuacccuguugguauaaag

SEQ ID NO: 1189 - RNA, 25 nt, Artificial Sequence
  Description of Artificial Sequence: Synthetic oligonucleotide
  Description of Combined DNA/RNA Molecule: Synthetic oligonucleotide
agaaaaaaaaaaucaugcauucuua

SEQ ID NO: 1190 - RNA, 25 nt, Artificial Sequence
  Description of Artificial Sequence: Synthetic oligonucleotide
  Description of Combined DNA/RNA Molecule: Synthetic oligonucleotide
uuuuaugcacuuugucgcuauuaac

SEQ ID NO: 1191 - RNA, 25 nt, Artificial Sequence
  Description of Artificial Sequence: Synthetic oligonucleotide
  Description of Combined DNA/RNA Molecule: Synthetic oligonucleotide
uuaugcacuuugucgcuauuaacau

SEQ ID NO: 1192 - RNA, 25 nt, Artificial Sequence
  Description of Artificial Sequence: Synthetic oligonucleotide
  Description of Combined DNA/RNA Molecule: Synthetic oligonucleotide
auuaacauccuuuuuuucauguaga

SEQ ID NO: 1193 - RNA, 25 nt, Artificial Sequence
  Description of Artificial Sequence: Synthetic oligonucleotide
  Description of Combined DNA/RNA Molecule: Synthetic oligonucleotide
aauuuuagaagcauuauuuuaggaa

SEQ ID NO: 1194 - RNA, 25 nt, Artificial Sequence
  Description of Artificial Sequence: Synthetic oligonucleotide
  Description of Combined DNA/RNA Molecule: Synthetic oligonucleotide
uuuuagaagcauuauuuuaggaaua

SEQ ID NO: 1195 - RNA, 25 nt, Artificial Sequence
  Description of Artificial Sequence: Synthetic oligonucleotide
  Description of Combined DNA/RNA Molecule: Synthetic oligonucleotide
uuagaagcauuauuuuaggaauaua

SEQ ID NO: 1196 - RNA, 25 nt, Artificial Sequence
  Description of Artificial Sequence: Synthetic oligonucleotide
  Description of Combined DNA/RNA Molecule: Synthetic oligonucleotide
uaaauaucuuguuuuuucuauguac

SEQ ID NO: 1197 - RNA, 25 nt, Artificial Sequence
  Description of Artificial Sequence: Synthetic oligonucleotide
  Description of Combined DNA/RNA Molecule: Synthetic oligonucleotide
uuccuuuugcucuuugugguuggau

SEQ ID NO: 1198 - RNA, 25 nt, Artificial Sequence
  Description of Artificial Sequence: Synthetic oligonucleotide
  Description of Combined DNA/RNA Molecule: Synthetic oligonucleotide
uccuuuugcucuuugugguuggauc

SEQ ID NO: 1199 - RNA, 25 nt, Artificial Sequence
  Description of Artificial Sequence: Synthetic oligonucleotide
  Description of Combined DNA/RNA Molecule: Synthetic oligonucleotide
ccuuuugcucuuugugguuggaucu

SEQ ID NO: 1200 - RNA, 25 nt, Artificial Sequence
  Description of Artificial Sequence: Synthetic oligonucleotide
  Description of Combined DNA/RNA Molecule: Synthetic oligonucleotide
cuuuugcucuuugugguuggaucua

SEQ ID NO: 1201 - RNA, 25 nt, Artificial Sequence
  Description of Artificial Sequence: Synthetic oligonucleotide
  Description of Combined DNA/RNA Molecule: Synthetic oligonucleotide
uuuugcucuuugugguuggaucuaa

SEQ ID NO: 1202 - RNA, 25 nt, Artificial Sequence
  Description of Artificial Sequence: Synthetic oligonucleotide
  Description of Combined DNA/RNA Molecule: Synthetic oligonucleotide
uuugcucuuugugguuggaucuaac

SEQ ID NO: 1203 - RNA, 25 nt, Artificial Sequence
  Description of Artificial Sequence: Synthetic oligonucleotide
  Description of Combined DNA/RNA Molecule: Synthetic oligonucleotide
uugcucuuugugguuggaucuaaca

SEQ ID NO: 1204 - RNA, 25 nt, Artificial Sequence
  Description of Artificial Sequence: Synthetic oligonucleotide
  Description of Combined DNA/RNA Molecule: Synthetic oligonucleotide
ugcucuuugugguuggaucuaacac

SEQ ID NO: 1205 - RNA, 25 nt, Artificial Sequence
  Description of Artificial Sequence: Synthetic oligonucleotide
  Description of Combined DNA/RNA Molecule: Synthetic oligonucleotide
agaaaccuacugcagggugaagaau

SEQ ID NO: 1206 - RNA, 25 nt, Artificial Sequence
  Description of Artificial Sequence: Synthetic oligonucleotide
  Description of Combined DNA/RNA Molecule: Synthetic oligonucleotide
aauauugaaauuccuuuagauagca

SEQ ID NO: 1207 - RNA, 25 nt, Artificial Sequence
  Description of Artificial Sequence: Synthetic oligonucleotide
  Description of Combined DNA/RNA Molecule: Synthetic oligonucleotide
aaaccuacugcagggugaagaauua

SEQ ID NO: 1208 - RNA, 25 nt, Artificial Sequence
  Description of Artificial Sequence: Synthetic oligonucleotide
  Description of Combined DNA/RNA Molecule: Synthetic oligonucleotide
cuacugcagggugaagaauuacuca

SEQ ID NO: 1209 - RNA, 25 nt, Artificial Sequence
  Description of Artificial Sequence: Synthetic oligonucleotide
  Description of Combined DNA/RNA Molecule: Synthetic oligonucleotide
uuuuuuuucacauuuuacauaaaua

SEQ ID NO: 1210 - RNA, 25 nt, Artificial Sequence
  Description of Artificial Sequence: Synthetic oligonucleotide
  Description of Combined DNA/RNA Molecule: Synthetic oligonucleotide
ucaagcaacugucauauauaacacc

SEQ ID NO: 1211 - RNA, 25 nt, Artificial Sequence
  Description of Artificial Sequence: Synthetic oligonucleotide
  Description of Combined DNA/RNA Molecule: Synthetic oligonucleotide
cuuuggaucaaguuaacugagcuuu

SEQ ID NO: 1212 - RNA, 25 nt, Artificial Sequence
  Description of Artificial Sequence: Synthetic oligonucleotide
  Description of Combined DNA/RNA Molecule: Synthetic oligonucleotide
cgaagcuuuuuucucagaaugaagu

SEQ ID NO: 1213 - RNA, 25 nt, Artificial Sequence
  Description of Artificial Sequence: Synthetic oligonucleotide
  Description of Combined DNA/RNA Molecule: Synthetic oligonucleotide
cucuuugugguuggaucuaacacua

SEQ ID NO: 1214 - RNA, 25 nt, Artificial Sequence
  Description of Artificial Sequence: Synthetic oligonucleotide
  Description of Combined DNA/RNA Molecule: Synthetic oligonucleotide
gcauuauuuuaggaauauauaguug

SEQ ID NO: 1215 - RNA, 25 nt, Artificial Sequence
  Description of Artificial Sequence: Synthetic oligonucleotide
  Description of Combined DNA/RNA Molecule: Synthetic oligonucleotide
uuaccacagcugaccaguuaugauu

SEQ ID NO: 1216 - RNA, 25 nt, Artificial Sequence
  Description of Artificial Sequence: Synthetic oligonucleotide
  Description of Combined DNA/RNA Molecule: Synthetic oligonucleotide
aaacucaagcaacugucauauauaa

SEQ ID NO: 1217 - RNA, 25 nt, Artificial Sequence
  Description of Artificial Sequence: Synthetic oligonucleotide
  Description of Combined DNA/RNA Molecule: Synthetic oligonucleotide
uggauuaccacagcugaccaguuau

SEQ ID NO: 1218 - RNA, 25 nt, Artificial Sequence
  Description of Artificial Sequence: Synthetic oligonucleotide
  Description of Combined DNA/RNA Molecule: Synthetic oligonucleotide
gcagucuauuuauauuuucuacauc

SEQ ID NO: 1219 - RNA, 25 nt, Artificial Sequence
  Description of Artificial Sequence: Synthetic oligonucleotide
  Description of Combined DNA/RNA Molecule: Synthetic oligonucleotide
gauuuucucccuucaacaaacagaa

SEQ ID NO: 1220 - RNA, 25 nt, Artificial Sequence
  Description of Artificial Sequence: Synthetic oligonucleotide
  Description of Combined DNA/RNA Molecule: Synthetic oligonucleotide
uuacucagagcuuuggaucaaguua

SEQ ID NO: 1221 - RNA, 25 nt, Artificial Sequence
  Description of Artificial Sequence: Synthetic oligonucleotide
  Description of Combined DNA/RNA Molecule: Synthetic oligonucleotide
gaguaauuuuagaagcauuauuuua

SEQ ID NO: 1222 - RNA, 25 nt, Artificial Sequence
  Description of Artificial Sequence: Synthetic oligonucleotide
  Description of Combined DNA/RNA Molecule: Synthetic oligonucleotide
uaauuuuagaagccuggcuacaaua

SEQ ID NO: 1223 - RNA, 25 nt, Artificial Sequence
  Description of Artificial Sequence: Synthetic oligonucleotide
  Description of Combined DNA/RNA Molecule: Synthetic oligonucleotide
augcacuuugucgcuauuaacaucc

SEQ ID NO: 1224 - RNA, 25 nt, Artificial Sequence
  Description of Artificial Sequence: Synthetic oligonucleotide
  Description of Combined DNA/RNA Molecule: Synthetic oligonucleotide
cagcagaaaccuacugcagggugaa

SEQ ID NO: 1225 - RNA, 25 nt, Artificial Sequence
  Description of Artificial Sequence: Synthetic oligonucleotide
  Description of Combined DNA/RNA Molecule: Synthetic oligonucleotide
agaauuacucagagcuuuggaucaa

SEQ ID NO: 1226 - RNA, 25 nt, Artificial Sequence
  Description of Artificial Sequence: Synthetic oligonucleotide
  Description of Combined DNA/RNA Molecule: Synthetic oligonucleotide
gaagaauuacucagagcuuuggauc

SEQ ID NO: 1227 - RNA, 25 nt, Artificial Sequence
  Description of Artificial Sequence: Synthetic oligonucleotide
  Description of Combined DNA/RNA Molecule: Synthetic oligonucleotide
acucagagcuuuggaucaaguuaac

SEQ ID NO: 1228 - RNA, 27 nt, Artificial Sequence
  Description of Artificial Sequence: Synthetic oligonucleotide
  Description of Combined DNA/RNA Molecule: Synthetic oligonucleotide
gugaagacaucgcggggaccgauucca

SEQ ID NO: 1229 - RNA, 27 nt, Artificial Sequence
  Description of Artificial Sequence: Synthetic oligonucleotide
  Description of Combined DNA/RNA Molecule: Synthetic oligonucleotide
aaguucugaacgucgaaaagaaaagca

SEQ ID NO: 1230 - RNA, 27 nt, Artificial Sequence
  Description of Artificial Sequence: Synthetic oligonucleotide
  Description of Combined DNA/RNA Molecule: Synthetic oligonucleotide
ucugaaguuuuuuaugagcuugcuccc

SEQ ID NO: 1231 - RNA, 27 nt, Artificial Sequence
  Description of Artificial Sequence: Synthetic oligonucleotide
  Description of Combined DNA/RNA Molecule: Synthetic oligonucleotide
aaguuuuuuaugagcuugcucaucaac

SEQ ID NO: 1232 - RNA, 27 nt, Artificial Sequence
  Description of Artificial Sequence: Synthetic oligonucleotide
  Description of Combined DNA/RNA Molecule: Synthetic oligonucleotide
gaugaauugcuuuuauuugaaagcccc

SEQ ID NO: 1233 - RNA, 27 nt, Artificial Sequence
  Description of Artificial Sequence: Synthetic oligonucleotide
  Description of Combined DNA/RNA Molecule: Synthetic oligonucleotide
aagccuuggaugguuuuguuaugguca

SEQ ID NO: 1234 - RNA, 27 nt, Artificial Sequence
  Description of Artificial Sequence: Synthetic oligonucleotide
  Description of Combined DNA/RNA Molecule: Synthetic oligonucleotide
gccuuggaugguuuuguuaugguucca

SEQ ID NO: 1235 - RNA, 27 nt, Artificial Sequence
  Description of Artificial Sequence: Synthetic oligonucleotide
  Description of Combined DNA/RNA Molecule: Synthetic oligonucleotide
cuuggaugguuuuguuaugguucucca

SEQ ID NO: 1236 - RNA, 27 nt, Artificial Sequence
  Description of Artificial Sequence: Synthetic oligonucleotide
  Description of Combined DNA/RNA Molecule: Synthetic oligonucleotide
uggaugguuuuguuaugguucucacca

SEQ ID NO: 1237 - RNA, 27 nt, Artificial Sequence
  Description of Artificial Sequence: Synthetic oligonucleotide
  Description of Combined DNA/RNA Molecule: Synthetic oligonucleotide
ugauuuacauuucugauaaugugaaac

SEQ ID NO: 1238 - RNA, 27 nt, Artificial Sequence
  Description of Artificial Sequence: Synthetic oligonucleotide
  Description of Combined DNA/RNA Molecule: Synthetic oligonucleotide
guguuugauuuuacucauccaugugca

SEQ ID NO: 1239 - RNA, 27 nt, Artificial Sequence
  Description of Artificial Sequence: Synthetic oligonucleotide
  Description of Combined DNA/RNA Molecule: Synthetic oligonucleotide
acaguaaccaaccucaguguggguacc

SEQ ID NO: 1240 - RNA, 27 nt, Artificial Sequence
  Description of Artificial Sequence: Synthetic oligonucleotide
  Description of Combined DNA/RNA Molecule: Synthetic oligonucleotide
ggugcugauuugugaacccauuccuac

SEQ ID NO: 1241 - RNA, 27 nt, Artificial Sequence
  Description of Artificial Sequence: Synthetic oligonucleotide
  Description of Combined DNA/RNA Molecule: Synthetic oligonucleotide
uauuaucaugcuuuggacucugauccc

SEQ ID NO: 1242 - RNA, 27 nt, Artificial Sequence
  Description of Artificial Sequence: Synthetic oligonucleotide
  Description of Combined DNA/RNA Molecule: Synthetic oligonucleotide
caugcuuuggacucugaucaucugaaa

SEQ ID NO: 1243 - RNA, 27 nt, Artificial Sequence
  Description of Artificial Sequence: Synthetic oligonucleotide
  Description of Combined DNA/RNA Molecule: Synthetic oligonucleotide
gcuuuggacucugaucaucugaccacc

SEQ ID NO: 1244 - RNA, 27 nt, Artificial Sequence
  Description of Artificial Sequence: Synthetic oligonucleotide
  Description of Combined DNA/RNA Molecule: Synthetic oligonucleotide
uacaggaugcuugccaaaagaggugac

SEQ ID NO: 1245 - RNA, 27 nt, Artificial Sequence
  Description of Artificial Sequence: Synthetic oligonucleotide
  Description of Combined DNA/RNA Molecule: Synthetic oligonucleotide
ggauaugucuggguugaaacucaagac

SEQ ID NO: 1246 - RNA, 27 nt, Artificial Sequence
  Description of Artificial Sequence: Synthetic oligonucleotide
  Description of Combined DNA/RNA Molecule: Synthetic oligonucleotide
auaugucuggguugaaacucaagcaca

SEQ ID NO: 1247 - RNA, 27 nt, Artificial Sequence
  Description of Artificial Sequence: Synthetic oligonucleotide
  Description of Combined DNA/RNA Molecule: Synthetic oligonucleotide
ggguugaaacucaagcaacugucaucc

SEQ ID NO: 1248 - RNA, 27 nt, Artificial Sequence
  Description of Artificial Sequence: Synthetic oligonucleotide
  Description of Combined DNA/RNA Molecule: Synthetic oligonucleotide
guugaaacucaagcaacugucauaucc

SEQ ID NO: 1249 - RNA, 27 nt, Artificial Sequence
  Description of Artificial Sequence: Synthetic oligonucleotide
  Description of Combined DNA/RNA Molecule: Synthetic oligonucleotide
agcacgacuugauuuucucccuucaca

SEQ ID NO: 1250 - RNA, 27 nt, Artificial Sequence
  Description of Artificial Sequence: Synthetic oligonucleotide
  Description of Combined DNA/RNA Molecule: Synthetic oligonucleotide
acuugauuuucucccuucaacaaacca

SEQ ID NO: 1251 - RNA, 27 nt, Artificial Sequence
  Description of Artificial Sequence: Synthetic oligonucleotide
  Description of Combined DNA/RNA Molecule: Synthetic oligonucleotide
uugauuuucucccuucaacaaacagcc

SEQ ID NO: 1252 - RNA, 27 nt, Artificial Sequence
  Description of Artificial Sequence: Synthetic oligonucleotide
  Description of Combined DNA/RNA Molecule: Synthetic oligonucleotide
uuuucucccuucaacaaacagaaugca

SEQ ID NO: 1253 - RNA, 27 nt, Artificial Sequence
  Description of Artificial Sequence: Synthetic oligonucleotide
  Description of Combined DNA/RNA Molecule: Synthetic oligonucleotide
cacaaucauaucuuuagauuuuggcca

SEQ ID NO: 1254 - RNA, 27 nt, Artificial Sequence
  Description of Artificial Sequence: Synthetic oligonucleotide
  Description of Combined DNA/RNA Molecule: Synthetic oligonucleotide
aagaaguugcauuaaaauuagaacccc

SEQ ID NO: 1255 - RNA, 27 nt, Artificial Sequence
  Description of Artificial Sequence: Synthetic oligonucleotide
  Description of Combined DNA/RNA Molecule: Synthetic oligonucleotide
ggaagcacuagacaaaguucaccugca

SEQ ID NO: 1256 - RNA, 27 nt, Artificial Sequence
  Description of Artificial Sequence: Synthetic oligonucleotide
  Description of Combined DNA/RNA Molecule: Synthetic oligonucleotide
gcacuagacaaaguucaccugagcccc

SEQ ID NO: 1257 - RNA, 27 nt, Artificial Sequence
  Description of Artificial Sequence: Synthetic oligonucleotide
  Description of Combined DNA/RNA Molecule: Synthetic oligonucleotide
acuagacaaaguucaccugagccuacc

SEQ ID NO: 1258 - RNA, 27 nt, Artificial Sequence
  Description of Artificial Sequence: Synthetic oligonucleotide
  Description of Combined DNA/RNA Molecule: Synthetic oligonucleotide
ugguagaaaaacuuuuugcugaagaac

SEQ ID NO: 1259 - RNA, 27 nt, Artificial Sequence
  Description of Artificial Sequence: Synthetic oligonucleotide
  Description of Combined DNA/RNA Molecule: Synthetic oligonucleotide
agcaaaagacaauuauuuuaauaccac

SEQ ID NO: 1260 - RNA, 27 nt, Artificial Sequence
  Description of Artificial Sequence: Synthetic oligonucleotide
  Description of Combined DNA/RNA Molecule: Synthetic oligonucleotide
uggauuaccacagcugaccaguuauac

SEQ ID NO: 1261 - RNA, 27 nt, Artificial Sequence
  Description of Artificial Sequence: Synthetic oligonucleotide
  Description of Combined DNA/RNA Molecule: Synthetic oligonucleotide
agcuuuggaucaaguuaacugagcucc

SEQ ID NO: 1262 - RNA, 27 nt, Artificial Sequence
  Description of Artificial Sequence: Synthetic oligonucleotide
  Description of Combined DNA/RNA Molecule: Synthetic oligonucleotide
uucauuccuuuuuuuggacacugguaa

SEQ ID NO: 1263 - RNA, 27 nt, Artificial Sequence
  Description of Artificial Sequence: Synthetic oligonucleotide
  Description of Combined DNA/RNA Molecule: Synthetic oligonucleotide
uuuuuuuggacacugguggcucauuca

SEQ ID NO: 1264 - RNA, 27 nt, Artificial Sequence
  Description of Artificial Sequence: Synthetic oligonucleotide
  Description of Combined DNA/RNA Molecule: Synthetic oligonucleotide
aagcagucuauuuauauuuucuacaca

SEQ ID NO: 1265 - RNA, 27 nt, Artificial Sequence
  Description of Artificial Sequence: Synthetic oligonucleotide
  Description of Combined DNA/RNA Molecule: Synthetic oligonucleotide
gcagucuauuuauauuuucuacauccc

SEQ ID NO: 1266 - RNA, 27 nt, Artificial Sequence
  Description of Artificial Sequence: Synthetic oligonucleotide
  Description of Combined DNA/RNA Molecule: Synthetic oligonucleotide
cuauuuauauuuucuacaucuaauucc

SEQ ID NO: 1267 - RNA, 27 nt, Artificial Sequence
  Description of Artificial Sequence: Synthetic oligonucleotide
  Description of Combined DNA/RNA Molecule: Synthetic oligonucleotide
cuuaauuuacauuaaugcucuuuuucc

SEQ ID NO: 1268 - RNA, 27 nt, Artificial Sequence
  Description of Artificial Sequence: Synthetic oligonucleotide
  Description of Combined DNA/RNA Molecule: Synthetic oligonucleotide
ucuuuaaugcuggaucacagacagcca

SEQ ID NO: 1269 - RNA, 27 nt, Artificial Sequence
  Description of Artificial Sequence: Synthetic oligonucleotide
  Description of Combined DNA/RNA Molecule: Synthetic oligonucleotide
agcucauuuucucaguuuuuugguacc

SEQ ID NO: 1270 - RNA, 27 nt, Artificial Sequence
  Description of Artificial Sequence: Synthetic oligonucleotide
  Description of Combined DNA/RNA Molecule: Synthetic oligonucleotide
ccuuuuuuuucacauuuuacauaaacc

SEQ ID NO: 1271 - RNA, 27 nt, Artificial Sequence
  Description of Artificial Sequence: Synthetic oligonucleotide
  Description of Combined DNA/RNA Molecule: Synthetic oligonucleotide
gccacaauugcacaauauauuuucucc

SEQ ID NO: 1272 - RNA, 27 nt, Artificial Sequence
  Description of Artificial Sequence: Synthetic oligonucleotide
  Description of Combined DNA/RNA Molecule: Synthetic oligonucleotide
cacaauugcacaauauauuuucuuacc

SEQ ID NO: 1273 - RNA, 27 nt, Artificial Sequence
  Description of Artificial Sequence: Synthetic oligonucleotide
  Description of Combined DNA/RNA Molecule: Synthetic oligonucleotide
cacaauauauuuucuuaaaaaauacac

SEQ ID NO: 1274 - RNA, 27 nt, Artificial Sequence
  Description of Artificial Sequence: Synthetic oligonucleotide
  Description of Combined DNA/RNA Molecule: Synthetic oligonucleotide
uauaaaacuaguuuuuaagaagaaacc

SEQ ID NO: 1275 - RNA, 27 nt, Artificial Sequence
  Description of Artificial Sequence: Synthetic oligonucleotide
  Description of Combined DNA/RNA Molecule: Synthetic oligonucleotide
gaagaaauuuuuuuuggccuaugaacc

SEQ ID NO: 1276 - RNA, 27 nt, Artificial Sequence
  Description of Artificial Sequence: Synthetic oligonucleotide
  Description of Combined DNA/RNA Molecule: Synthetic oligonucleotide
agaaauuuuuuuuggccuaugaaauca

SEQ ID NO: 1277 - RNA, 27 nt, Artificial Sequence
  Description of Artificial Sequence: Synthetic oligonucleotide
  Description of Combined DNA/RNA Molecule: Synthetic oligonucleotide
uauguggcauuuauuuggauaaaauca

SEQ ID NO: 1278 - RNA, 27 nt, Artificial Sequence
  Description of Artificial Sequence: Synthetic oligonucleotide
  Description of Combined DNA/RNA Molecule: Synthetic oligonucleotide
auaaaauucucaauucagagaaauccc

SEQ ID NO: 1279 - RNA, 27 nt, Artificial Sequence
  Description of Artificial Sequence: Synthetic oligonucleotide
  Description of Combined DNA/RNA Molecule: Synthetic oligonucleotide
auguuucuauagucacuuugccagcca

SEQ ID NO: 1280 - RNA, 27 nt, Artificial Sequence
  Description of Artificial Sequence: Synthetic oligonucleotide
  Description of Combined DNA/RNA Molecule: Synthetic oligonucleotide
cucaaaagaaaacaauacccuauguca

SEQ ID NO: 1281 - RNA, 27 nt, Artificial Sequence
  Description of Artificial Sequence: Synthetic oligonucleotide
  Description of Combined DNA/RNA Molecule: Synthetic oligonucleotide
uguucugccuacccuguugguauaaca

SEQ ID NO: 1282 - RNA, 27 nt, Artificial Sequence
  Description of Artificial Sequence: Synthetic oligonucleotide
  Description of Combined DNA/RNA Molecule: Synthetic oligonucleotide
caagaaaaaaaaaaucaugcauucucc

SEQ ID NO: 1283 - RNA, 27 nt, Artificial Sequence
  Description of Artificial Sequence: Synthetic oligonucleotide
  Description of Combined DNA/RNA Molecule: Synthetic oligonucleotide
gauuuuaugcacuuugucgcuauuaca

SEQ ID NO: 1284 - RNA, 27 nt, Artificial Sequence
  Description of Artificial Sequence: Synthetic oligonucleotide
  Description of Combined DNA/RNA Molecule: Synthetic oligonucleotide
uuuuaugcacuuugucgcuauuaaccc

SEQ ID NO: 1285 - RNA, 27 nt, Artificial Sequence
  Description of Artificial Sequence: Synthetic oligonucleotide
  Description of Combined DNA/RNA Molecule: Synthetic oligonucleotide
cuauuaacauccuuuuuuucauguaac

SEQ ID NO: 1286 - RNA, 27 nt, Artificial Sequence
  Description of Artificial Sequence: Synthetic oligonucleotide
  Description of Combined DNA/RNA Molecule: Synthetic oligonucleotide
guaauuuuagaagcauuauuuuaggcc

SEQ ID NO: 1287 - RNA, 27 nt, Artificial Sequence
  Description of Artificial Sequence: Synthetic oligonucleotide
  Description of Combined DNA/RNA Molecule: Synthetic oligonucleotide
aauuuuagaagcauuauuuuaggaacc

SEQ ID NO: 1288 - RNA, 27 nt, Artificial Sequence
  Description of Artificial Sequence: Synthetic oligonucleotide
  Description of Combined DNA/RNA Molecule: Synthetic oligonucleotide
uuuuagaagcauuauuuuaggaauacc

SEQ ID NO: 1289 - RNA, 27 nt, Artificial Sequence
  Description of Artificial Sequence: Synthetic oligonucleotide
  Description of Combined DNA/RNA Molecule: Synthetic oligonucleotide
aguaaauaucuuguuuuuucuauguca

SEQ ID NO: 1290 - RNA, 27 nt, Artificial Sequence
  Description of Artificial Sequence: Synthetic oligonucleotide
  Description of Combined DNA/RNA Molecule: Synthetic oligonucleotide
cauuccuuuugcucuuugugguuggcc

SEQ ID NO: 1291 - RNA, 27 nt, Artificial Sequence
  Description of Artificial Sequence: Synthetic oligonucleotide
  Description of Combined DNA/RNA Molecule: Synthetic oligonucleotide
auuccuuuugcucuuugugguuggaca

SEQ ID NO: 1292 - RNA, 27 nt, Artificial Sequence
  Description of Artificial Sequence: Synthetic oligonucleotide
  Description of Combined DNA/RNA Molecule: Synthetic oligonucleotide
uuccuuuugcucuuugugguuggauac

SEQ ID NO: 1293 - RNA, 27 nt, Artificial Sequence
  Description of Artificial Sequence: Synthetic oligonucleotide
  Description of Combined DNA/RNA Molecule: Synthetic oligonucleotide
uccuuuugcucuuugugguuggauccc

SEQ ID NO: 1294 - RNA, 27 nt, Artificial Sequence
  Description of Artificial Sequence: Synthetic oligonucleotide
  Description of Combined DNA/RNA Molecule: Synthetic oligonucleotide
ccuuuugcucuuugugguuggaucucc

SEQ ID NO: 1295 - RNA, 27 nt, Artificial Sequence
  Description of Artificial Sequence: Synthetic oligonucleotide
  Description of Combined DNA/RNA Molecule: Synthetic oligonucleotide
cuuuugcucuuugugguuggaucuaca

SEQ ID NO: 1296 - RNA, 27 nt, Artificial Sequence
  Description of Artificial Sequence: Synthetic oligonucleotide
  Description of Combined DNA/RNA Molecule: Synthetic oligonucleotide
uuuugcucuuugugguuggaucuaaac

SEQ ID NO: 1297 - RNA, 27 nt, Artificial Sequence
  Description of Artificial Sequence: Synthetic oligonucleotide
  Description of Combined DNA/RNA Molecule: Synthetic oligonucleotide
uuugcucuuugugguuggaucuaacca

SEQ ID NO: 1298 - RNA, 27 nt, Artificial Sequence
  Description of Artificial Sequence: Synthetic oligonucleotide
  Description of Combined DNA/RNA Molecule: Synthetic oligonucleotide
gcagaaaccuacugcagggugaagacc

SEQ ID NO: 1299 - RNA, 27 nt, Artificial Sequence
  Description of Artificial Sequence: Synthetic oligonucleotide
  Description of Combined DNA/RNA Molecule: Synthetic oligonucleotide
caaauauugaaauuccuuuagauagac

SEQ ID NO: 1300 - RNA, 27 nt, Artificial Sequence
  Description of Artificial Sequence: Synthetic oligonucleotide
  Description of Combined DNA/RNA Molecule: Synthetic oligonucleotide
agaaaccuacugcagggugaagaaucc

SEQ ID NO: 1301 - RNA, 27 nt, Artificial Sequence
  Description of Artificial Sequence: Synthetic oligonucleotide
  Description of Combined DNA/RNA Molecule: Synthetic oligonucleotide
accuacugcagggugaagaauuacuac

SEQ ID NO: 1302 - RNA, 27 nt, Artificial Sequence
  Description of Artificial Sequence: Synthetic oligonucleotide
  Description of Combined DNA/RNA Molecule: Synthetic oligonucleotide
ccuuuuuuuucacauuuuacauaaacc

SEQ ID NO: 1303 - RNA, 27 nt, Artificial Sequence
  Description of Artificial Sequence: Synthetic oligonucleotide
  Description of Combined DNA/RNA Molecule: Synthetic oligonucleotide
acucaagcaacugucauauauaacaaa

SEQ ID NO: 1304 - RNA, 27 nt, Artificial Sequence
  Description of Artificial Sequence: Synthetic oligonucleotide
  Description of Combined DNA/RNA Molecule: Synthetic oligonucleotide
agcuuuggaucaaguuaacugagcucc

SEQ ID NO: 1305 - RNA, 27 nt, Artificial Sequence
  Description of Artificial Sequence: Synthetic oligonucleotide
  Description of Combined DNA/RNA Molecule: Synthetic oligonucleotide
agcgaagcuuuuuucucagaaugaaac

SEQ ID NO: 1306 - RNA, 27 nt, Artificial Sequence
  Description of Artificial Sequence: Synthetic oligonucleotide
  Description of Combined DNA/RNA Molecule: Synthetic oligonucleotide
ugcucuuugugguuggaucuaacaccc

SEQ ID NO: 1307 - RNA, 27 nt, Artificial Sequence
  Description of Artificial Sequence: Synthetic oligonucleotide
  Description of Combined DNA/RNA Molecule: Synthetic oligonucleotide
aagcauuauuuuaggaauauauaguca

SEQ ID NO: 1308 - RNA, 27 nt, Artificial Sequence
  Description of Artificial Sequence: Synthetic oligonucleotide
  Description of Combined DNA/RNA Molecule: Synthetic oligonucleotide
gauuaccacagcugaccaguuaugacc

SEQ ID NO: 1309 - RNA, 27 nt, Artificial Sequence
  Description of Artificial Sequence: Synthetic oligonucleotide
  Description of Combined DNA/RNA Molecule: Synthetic oligonucleotide
ugaaacucaagcaacugucauauaucc

SEQ ID NO: 1310 - RNA, 27 nt, Artificial Sequence
  Description of Artificial Sequence: Synthetic oligonucleotide
  Description of Combined DNA/RNA Molecule: Synthetic oligonucleotide
aguggauuaccacagcugaccaguucc

SEQ ID NO: 1311 - RNA, 27 nt, Artificial Sequence
  Description of Artificial Sequence: Synthetic oligonucleotide
  Description of Combined DNA/RNA Molecule: Synthetic oligonucleotide
aagcagucuauuuauauuuucuacaca

SEQ ID NO: 1312 - RNA, 27 nt, Artificial Sequence
  Description of Artificial Sequence: Synthetic oligonucleotide
  Description of Combined DNA/RNA Molecule: Synthetic oligonucleotide
uugauuuucucccuucaacaaacagcc

SEQ ID NO: 1313 - RNA, 27 nt, Artificial Sequence
  Description of Artificial Sequence: Synthetic oligonucleotide
  Description of Combined DNA/RNA Molecule: Synthetic oligonucleotide
aauuacucagagcuuuggaucaagucc

SEQ ID NO: 1314 - RNA, 27 nt, Artificial Sequence
  Description of Artificial Sequence: Synthetic oligonucleotide
  Description of Combined DNA/RNA Molecule: Synthetic oligonucleotide
uugaguaauuuuagaagcauuauuucc

SEQ ID NO: 1315 - RNA, 27 nt, Artificial Sequence
  Description of Artificial Sequence: Synthetic oligonucleotide
  Description of Combined DNA/RNA Molecule: Synthetic oligonucleotide
ucuaauuuuagaagccuggcuacaacc

SEQ ID NO: 1316 - RNA, 27 nt, Artificial Sequence
  Description of Artificial Sequence: Synthetic oligonucleotide
  Description of Combined DNA/RNA Molecule: Synthetic oligonucleotide
uuaugcacuuugucgcuauuaacauaa

SEQ ID NO: 1317 - RNA, 27 nt, Artificial Sequence
  Description of Artificial Sequence: Synthetic oligonucleotide
  Description of Combined DNA/RNA Molecule: Synthetic oligonucleotide
ggcagcagaaaccuacugcagggugcc

SEQ ID NO: 1318 - RNA, 27 nt, Artificial Sequence
  Description of Artificial Sequence: Synthetic oligonucleotide
  Description of Combined DNA/RNA Molecule: Synthetic oligonucleotide
gaagaauuacucagagcuuuggauccc

SEQ ID NO: 1319 - RNA, 27 nt, Artificial Sequence
  Description of Artificial Sequence: Synthetic oligonucleotide
  Description of Combined DNA/RNA Molecule: Synthetic oligonucleotide
gugaagaauuacucagagcuuuggaca

SEQ ID NO: 1320 - RNA, 27 nt, Artificial Sequence
  Description of Artificial Sequence: Synthetic oligonucleotide
  Description of Combined DNA/RNA Molecule: Synthetic oligonucleotide
uuacucagagcuuuggaucaaguuaca

SEQ ID NO: 1321 - RNA, 27 nt, Artificial Sequence
  Description of Artificial Sequence: Synthetic oligonucleotide
  Description of Combined DNA/RNA Molecule: Synthetic oligonucleotide
gugaagacaucgcggggaccgauucac

SEQ ID NO: 1322 - RNA, 27 nt, Artificial Sequence
  Description of Artificial Sequence: Synthetic oligonucleotide
  Description of Combined DNA/RNA Molecule: Synthetic oligonucleotide
aaguucugaacgucgaaaagaaaaguc

SEQ ID NO: 1323 - RNA, 27 nt, Artificial Sequence
  Description of Artificial Sequence: Synthetic oligonucleotide
  Description of Combined DNA/RNA Molecule: Synthetic oligonucleotide
ucugaaguuuuuuaugagcuugcucau

SEQ ID NO: 1324 - RNA, 27 nt, Artificial Sequence
  Description of Artificial Sequence: Synthetic oligonucleotide
  Description of Combined DNA/RNA Molecule: Synthetic oligonucleotide
aaguuuuuuaugagcuugcucaucagu

SEQ ID NO: 1325 - RNA, 27 nt, Artificial Sequence
  Description of Artificial Sequence: Synthetic oligonucleotide
  Description of Combined DNA/RNA Molecule: Synthetic oligonucleotide
gaugaauugcuuuuauuugaaagccuu

SEQ ID NO: 1326 - RNA, 27 nt, Artificial Sequence
  Description of Artificial Sequence: Synthetic oligonucleotide
  Description of Combined DNA/RNA Molecule: Synthetic oligonucleotide
aagccuuggaugguuuuguuaugguuc

SEQ ID NO: 1327 - RNA, 27 nt, Artificial Sequence
  Description of Artificial Sequence: Synthetic oligonucleotide
  Description of Combined DNA/RNA Molecule: Synthetic oligonucleotide
gccuuggaugguuuuguuaugguucuc

SEQ ID NO: 1328 - RNA, 27 nt, Artificial Sequence
  Description of Artificial Sequence: Synthetic oligonucleotide
  Description of Combined DNA/RNA Molecule: Synthetic oligonucleotide
cuuggaugguuuuguuaugguucucac

SEQ ID NO: 1329 - RNA, 27 nt, Artificial Sequence
  Description of Artificial Sequence: Synthetic oligonucleotide
  Description of Combined DNA/RNA Molecule: Synthetic oligonucleotide
uggaugguuuuguuaugguucucacag

SEQ ID NO: 1330 - RNA, 27 nt, Artificial Sequence
  Description of Artificial Sequence: Synthetic oligonucleotide
  Description of Combined DNA/RNA Molecule: Synthetic oligonucleotide
ugauuuacauuucugauaaugugaaca

SEQ ID NO: 1331 - RNA, 27 nt, Artificial Sequence
  Description of Artificial Sequence: Synthetic oligonucleotide
  Description of Combined DNA/RNA Molecule: Synthetic oligonucleotide
guguuugauuuuacucauccaugugac

SEQ ID NO: 1332 - RNA, 27 nt, Artificial Sequence
  Description of Artificial Sequence: Synthetic oligonucleotide
  Description of Combined DNA/RNA Molecule: Synthetic oligonucleotide
acaguaaccaaccucaguguggguaua

SEQ ID NO: 1333 - RNA, 27 nt, Artificial Sequence
  Description of Artificial Sequence: Synthetic oligonucleotide
  Description of Combined DNA/RNA Molecule: Synthetic oligonucleotide
ggugcugauuugugaacccauuccuca

SEQ ID NO: 1334 - RNA, 27 nt, Artificial Sequence
  Description of Artificial Sequence: Synthetic oligonucleotide
  Description of Combined DNA/RNA Molecule: Synthetic oligonucleotide
uauuaucaugcuuuggacucugaucau

SEQ ID NO: 1335 - RNA, 27 nt, Artificial Sequence
  Description of Artificial Sequence: Synthetic oligonucleotide
  Description of Combined DNA/RNA Molecule: Synthetic oligonucleotide
caugcuuuggacucugaucaucugacc

SEQ ID NO: 1336 - RNA, 27 nt, Artificial Sequence
  Description of Artificial Sequence: Synthetic oligonucleotide
  Description of Combined DNA/RNA Molecule: Synthetic oligonucleotide
gcuuuggacucugaucaucugaccaaa

SEQ ID NO: 1337 - RNA, 27 nt, Artificial Sequence
  Description of Artificial Sequence: Synthetic oligonucleotide
  Description of Combined DNA/RNA Molecule: Synthetic oligonucleotide
uacaggaugcuugccaaaagaggugga

SEQ ID NO: 1338 - RNA, 27 nt, Artificial Sequence
  Description of Artificial Sequence: Synthetic oligonucleotide
  Description of Combined DNA/RNA Molecule: Synthetic oligonucleotide
ggauaugucuggguugaaacucaagca

SEQ ID NO: 1339 - RNA, 27 nt, Artificial Sequence
  Description of Artificial Sequence: Synthetic oligonucleotide
  Description of Combined DNA/RNA Molecule: Synthetic oligonucleotide
auaugucuggguugaaacucaagcaac

SEQ ID NO: 1340 - RNA, 27 nt, Artificial Sequence
  Description of Artificial Sequence: Synthetic oligonucleotide
  Description of Combined DNA/RNA Molecule: Synthetic oligonucleotide
ggguugaaacucaagcaacugucauau

SEQ ID NO: 1341 - RNA, 27 nt, Artificial Sequence
  Description of Artificial Sequence: Synthetic oligonucleotide
  Description of Combined DNA/RNA Molecule: Synthetic oligonucleotide
guugaaacucaagcaacugucauauau

SEQ ID NO: 1342 - RNA, 27 nt, Artificial Sequence
  Description of Artificial Sequence: Synthetic oligonucleotide
  Description of Combined DNA/RNA Molecule: Synthetic oligonucleotide
agcacgacuugauuuucucccuucaac

SEQ ID NO: 1343 - RNA, 27 nt, Artificial Sequence
  Description of Artificial Sequence: Synthetic oligonucleotide
  Description of Combined DNA/RNA Molecule: Synthetic oligonucleotide
acuugauuuucucccuucaacaaacag

SEQ ID NO: 1344 - RNA, 27 nt, Artificial Sequence
  Description of Artificial Sequence: Synthetic oligonucleotide
  Description of Combined DNA/RNA Molecule: Synthetic oligonucleotide
uugauuuucucccuucaacaaacagaa

SEQ ID NO: 1345 - RNA, 27 nt, Artificial Sequence
  Description of Artificial Sequence: Synthetic oligonucleotide
  Description of Combined DNA/RNA Molecule: Synthetic oligonucleotide
uuuucucccuucaacaaacagaaugug

SEQ ID NO: 1346 - RNA, 27 nt, Artificial Sequence
  Description of Artificial Sequence: Synthetic oligonucleotide
  Description of Combined DNA/RNA Molecule: Synthetic oligonucleotide
cacaaucauaucuuuagauuuuggcag

SEQ ID NO: 1347 - RNA, 27 nt, Artificial Sequence
  Description of Artificial Sequence: Synthetic oligonucleotide
  Description of Combined DNA/RNA Molecule: Synthetic oligonucleotide
aagaaguugcauuaaaauuagaaccaa

SEQ ID NO: 1348 - RNA, 27 nt, Artificial Sequence
  Description of Artificial Sequence: Synthetic oligonucleotide
  Description of Combined DNA/RNA Molecule: Synthetic oligonucleotide
ggaagcacuagacaaaguucaccugag

SEQ ID NO: 1349 - RNA, 27 nt, Artificial Sequence
  Description of Artificial Sequence: Synthetic oligonucleotide
  Description of Combined DNA/RNA Molecule: Synthetic oligonucleotide
gcacuagacaaaguucaccugagccua

SEQ ID NO: 1350 - RNA, 27 nt, Artificial Sequence
  Description of Artificial Sequence: Synthetic oligonucleotide
  Description of Combined DNA/RNA Molecule: Synthetic oligonucleotide
acuagacaaaguucaccugagccuaau

SEQ ID NO: 1351 - RNA, 27 nt, Artificial Sequence
  Description of Artificial Sequence: Synthetic oligonucleotide
  Description of Combined DNA/RNA Molecule: Synthetic oligonucleotide
ugguagaaaaacuuuuugcugaagaca

SEQ ID NO: 1352 - RNA, 27 nt, Artificial Sequence
  Description of Artificial Sequence: Synthetic oligonucleotide
  Description of Combined DNA/RNA Molecule: Synthetic oligonucleotide
agcaaaagacaauuauuuuaauacccu

SEQ ID NO: 1353 - RNA, 27 nt, Artificial Sequence
  Description of Artificial Sequence: Synthetic oligonucleotide
  Description of Combined DNA/RNA Molecule: Synthetic oligonucleotide
uggauuaccacagcugaccaguuauga

SEQ ID NO: 1354 - RNA, 27 nt, Artificial Sequence
  Description of Artificial Sequence: Synthetic oligonucleotide
  Description of Combined DNA/RNA Molecule: Synthetic oligonucleotide
agcuuuggaucaaguuaacugagcuuu

SEQ ID NO: 1355 - RNA, 27 nt, Artificial Sequence
  Description of Artificial Sequence: Synthetic oligonucleotide
  Description of Combined DNA/RNA Molecule: Synthetic oligonucleotide
uucauuccuuuuuuuggacacuggugg

SEQ ID NO: 1356 - RNA, 27 nt, Artificial Sequence
  Description of Artificial Sequence: Synthetic oligonucleotide
  Description of Combined DNA/RNA Molecule: Synthetic oligonucleotide
uuuuuuuggacacugguggcucauuac

SEQ ID NO: 1357 - RNA, 27 nt, Artificial Sequence
  Description of Artificial Sequence: Synthetic oligonucleotide
  Description of Combined DNA/RNA Molecule: Synthetic oligonucleotide
aagcagucuauuuauauuuucuacauc

SEQ ID NO: 1358 - RNA, 27 nt, Artificial Sequence
  Description of Artificial Sequence: Synthetic oligonucleotide
  Description of Combined DNA/RNA Molecule: Synthetic oligonucleotide
gcagucuauuuauauuuucuacaucua

SEQ ID NO: 1359 - RNA, 27 nt, Artificial Sequence
  Description of Artificial Sequence: Synthetic oligonucleotide
  Description of Combined DNA/RNA Molecule: Synthetic oligonucleotide
cuauuuauauuuucuacaucuaauuuu

SEQ ID NO: 1360 - RNA, 27 nt, Artificial Sequence
  Description of Artificial Sequence: Synthetic oligonucleotide
  Description of Combined DNA/RNA Molecule: Synthetic oligonucleotide
cuuaauuuacauuaaugcucuuuuuua

SEQ ID NO: 1361 - RNA, 27 nt, Artificial Sequence
  Description of Artificial Sequence: Synthetic oligonucleotide
  Description of Combined DNA/RNA Molecule: Synthetic oligonucleotide
ucuuuaaugcuggaucacagacagcuc

SEQ ID NO: 1362 - RNA, 27 nt, Artificial Sequence
  Description of Artificial Sequence: Synthetic oligonucleotide
  Description of Combined DNA/RNA Molecule: Synthetic oligonucleotide
agcucauuuucucaguuuuuugguauu

SEQ ID NO: 1363 - RNA, 27 nt, Artificial Sequence
  Description of Artificial Sequence: Synthetic oligonucleotide
  Description of Combined DNA/RNA Molecule: Synthetic oligonucleotide
ccuuuuuuuucacauuuuacauaaaua

SEQ ID NO: 1364 - RNA, 27 nt, Artificial Sequence
  Description of Artificial Sequence: Synthetic oligonucleotide
  Description of Combined DNA/RNA Molecule: Synthetic oligonucleotide
gccacaauugcacaauauauuuucuua

SEQ ID NO: 1365 - RNA, 27 nt, Artificial Sequence
  Description of Artificial Sequence: Synthetic oligonucleotide
  Description of Combined DNA/RNA Molecule: Synthetic oligonucleotide
cacaauugcacaauauauuuucuuaaa

SEQ ID NO: 1366 - RNA, 27 nt, Artificial Sequence
  Description of Artificial Sequence: Synthetic oligonucleotide
  Description of Combined DNA/RNA Molecule: Synthetic oligonucleotide
cacaauauauuuucuuaaaaaauacca

SEQ ID NO: 1367 - RNA, 27 nt, Artificial Sequence
  Description of Artificial Sequence: Synthetic oligonucleotide
  Description of Combined DNA/RNA Molecule: Synthetic oligonucleotide
uauaaaacuaguuuuuaagaagaaauu

SEQ ID NO: 1368 - RNA, 27 nt, Artificial Sequence
  Description of Artificial Sequence: Synthetic oligonucleotide
  Description of Combined DNA/RNA Molecule: Synthetic oligonucleotide
gaagaaauuuuuuuuggccuaugaaau

SEQ ID NO: 1369 - RNA, 27 nt, Artificial Sequence
  Description of Artificial Sequence: Synthetic oligonucleotide
  Description of Combined DNA/RNA Molecule: Synthetic oligonucleotide
agaaauuuuuuuuggccuaugaaauug

SEQ ID NO: 1370 - RNA, 27 nt, Artificial Sequence
  Description of Artificial Sequence: Synthetic oligonucleotide
  Description of Combined DNA/RNA Molecule: Synthetic oligonucleotide
uauguggcauuuauuuggauaaaauuc

SEQ ID NO: 1371 - RNA, 27 nt, Artificial Sequence
  Description of Artificial Sequence: Synthetic oligonucleotide
  Description of Combined DNA/RNA Molecule: Synthetic oligonucleotide
auaaaauucucaauucagagaaaucau

SEQ ID NO: 1372 - RNA, 27 nt, Artificial Sequence
  Description of Artificial Sequence: Synthetic oligonucleotide
  Description of Combined DNA/RNA Molecule: Synthetic oligonucleotide
auguuucuauagucacuuugccagcuc

SEQ ID NO: 1373 - RNA, 27 nt, Artificial Sequence
  Description of Artificial Sequence: Synthetic oligonucleotide
  Description of Combined DNA/RNA Molecule: Synthetic oligonucleotide
cucaaaagaaaacaauacccuauguag

SEQ ID NO: 1374 - RNA, 27 nt, Artificial Sequence
  Description of Artificial Sequence: Synthetic oligonucleotide
  Description of Combined DNA/RNA Molecule: Synthetic oligonucleotide
uguucugccuacccuguugguauaaag

SEQ ID NO: 1375 - RNA, 27 nt, Artificial Sequence
  Description of Artificial Sequence: Synthetic oligonucleotide
  Description of Combined DNA/RNA Molecule: Synthetic oligonucleotide
caagaaaaaaaaaaucaugcauucuua

SEQ ID NO: 1376 - RNA, 27 nt, Artificial Sequence
  Description of Artificial Sequence: Synthetic oligonucleotide
  Description of Combined DNA/RNA Molecule: Synthetic oligonucleotide
gauuuuaugcacuuugucgcuauuaac

SEQ ID NO: 1377 - RNA, 27 nt, Artificial Sequence
  Description of Artificial Sequence: Synthetic oligonucleotide
  Description of Combined DNA/RNA Molecule: Synthetic oligonucleotide
uuuuaugcacuuugucgcuauuaacau

SEQ ID NO: 1378 - RNA, 27 nt, Artificial Sequence
  Description of Artificial Sequence: Synthetic oligonucleotide
  Description of Combined DNA/RNA Molecule: Synthetic oligonucleotide
cuauuaacauccuuuuuuucauguaga

SEQ ID NO: 1379 - RNA, 27 nt, Artificial Sequence
  Description of Artificial Sequence: Synthetic oligonucleotide
  Description of Combined DNA/RNA Molecule: Synthetic oligonucleotide
guaauuuuagaagcauuauuuuaggaa

SEQ ID NO: 1380 - RNA, 27 nt, Artificial Sequence
  Description of Artificial Sequence: Synthetic oligonucleotide
  Description of Combined DNA/RNA Molecule: Synthetic oligonucleotide
aauuuuagaagcauuauuuuaggaaua

SEQ ID NO: 1381 - RNA, 27 nt, Artificial Sequence
  Description of Artificial Sequence: Synthetic oligonucleotide
  Description of Combined DNA/RNA Molecule: Synthetic oligonucleotide
uuuuagaagcauuauuuuaggaauaua

SEQ ID NO: 1382 - RNA, 27 nt, Artificial Sequence
  Description of Artificial Sequence: Synthetic oligonucleotide
  Description of Combined DNA/RNA Molecule: Synthetic oligonucleotide
aguaaauaucuuguuuuuucuauguac

SEQ ID NO: 1383 - RNA, 27 nt, Artificial Sequence
  Description of Artificial Sequence: Synthetic oligonucleotide
  Description of Combined DNA/RNA Molecule: Synthetic oligonucleotide
cauuccuuuugcucuuugugguuggau

SEQ ID NO: 1384 - RNA, 27 nt, Artificial Sequence
  Description of Artificial Sequence: Synthetic oligonucleotide
  Description of Combined DNA/RNA Molecule: Synthetic oligonucleotide
auuccuuuugcucuuugugguuggauc

SEQ ID NO: 1385 - RNA, 27 nt, Artificial Sequence
  Description of Artificial Sequence: Synthetic oligonucleotide
  Description of Combined DNA/RNA Molecule: Synthetic oligonucleotide
uuccuuuugcucuuugugguuggaucu

SEQ ID NO: 1386 - RNA, 27 nt, Artificial Sequence
  Description of Artificial Sequence: Synthetic oligonucleotide
  Description of Combined DNA/RNA Molecule: Synthetic oligonucleotide
uccuuuugcucuuugugguuggaucua

SEQ ID NO: 1387 - RNA, 27 nt, Artificial Sequence
  Description of Artificial Sequence: Synthetic oligonucleotide
  Description of Combined DNA/RNA Molecule: Synthetic oligonucleotide
ccuuuugcucuuugugguuggaucuaa

SEQ ID NO: 1388 - RNA, 27 nt, Artificial Sequence
  Description of Artificial Sequence: Synthetic oligonucleotide
  Description of Combined DNA/RNA Molecule: Synthetic oligonucleotide
cuuuugcucuuugugguuggaucuaac

SEQ ID NO: 1389 - RNA, 27 nt, Artificial Sequence
  Description of Artificial Sequence: Synthetic oligonucleotide
  Description of Combined DNA/RNA Molecule: Synthetic oligonucleotide
uuuugcucuuugugguuggaucuaaca

SEQ ID NO: 1390 - RNA, 27 nt, Artificial Sequence
  Description of Artificial Sequence: Synthetic oligonucleotide
  Description of Combined DNA/RNA Molecule: Synthetic oligonucleotide
uuugcucuuugugguuggaucuaacac

SEQ ID NO: 1391 - RNA, 27 nt, Artificial Sequence
  Description of Artificial Sequence: Synthetic oligonucleotide
  Description of Combined DNA/RNA Molecule: Synthetic oligonucleotide
gcagaaaccuacugcagggugaagaau

SEQ ID NO: 1392 - RNA, 27 nt, Artificial Sequence
  Description of Artificial Sequence: Synthetic oligonucleotide
  Description of Combined DNA/RNA Molecule: Synthetic oligonucleotide
caaauauugaaauuccuuuagauagca

SEQ ID NO: 1393 - RNA, 27 nt, Artificial Sequence
  Description of Artificial Sequence: Synthetic oligonucleotide
  Description of Combined DNA/RNA Molecule: Synthetic oligonucleotide
agaaaccuacugcagggugaagaauua

SEQ ID NO: 1394 - RNA, 27 nt, Artificial Sequence
  Description of Artificial Sequence: Synthetic oligonucleotide
  Description of Combined DNA/RNA Molecule: Synthetic oligonucleotide
accuacugcagggugaagaauuacuca

SEQ ID NO: 1395 - RNA, 27 nt, Artificial Sequence
  Description of Artificial Sequence: Synthetic oligonucleotide
  Description of Combined DNA/RNA Molecule: Synthetic oligonucleotide
ccuuuuuuuucacauuuuacauaaaua

SEQ ID NO: 1396 - RNA, 27 nt, Artificial Sequence
  Description of Artificial Sequence: Synthetic oligonucleotide
  Description of Combined DNA/RNA Molecule: Synthetic oligonucleotide
acucaagcaacugucauauauaacacc

SEQ ID NO: 1397 - RNA, 27 nt, Artificial Sequence
  Description of Artificial Sequence: Synthetic oligonucleotide
  Description of Combined DNA/RNA Molecule: Synthetic oligonucleotide
agcuuuggaucaaguuaacugagcuuu

SEQ ID NO: 1398 - RNA, 27 nt, Artificial Sequence
  Description of Artificial Sequence: Synthetic oligonucleotide
  Description of Combined DNA/RNA Molecule: Synthetic oligonucleotide
agcgaagcuuuuuucucagaaugaagu

SEQ ID NO: 1399 - RNA, 27 nt, Artificial Sequence
  Description of Artificial Sequence: Synthetic oligonucleotide
  Description of Combined DNA/RNA Molecule: Synthetic oligonucleotide
ugcucuuugugguuggaucuaacacua

SEQ ID NO: 1400 - RNA, 27 nt, Artificial Sequence
  Description of Artificial Sequence: Synthetic oligonucleotide
  Description of Combined DNA/RNA Molecule: Synthetic oligonucleotide
aagcauuauuuuaggaauauauaguug

SEQ ID NO: 1401 - RNA, 27 nt, Artificial Sequence
  Description of Artificial Sequence: Synthetic oligonucleotide
  Description of Combined DNA/RNA Molecule: Synthetic oligonucleotide
gauuaccacagcugaccaguuaugauu

SEQ ID NO: 1402 - RNA, 27 nt, Artificial Sequence
  Description of Artificial Sequence: Synthetic oligonucleotide
  Description of Combined DNA/RNA Molecule: Synthetic oligonucleotide
ugaaacucaagcaacugucauauauaa

SEQ ID NO: 1403 - RNA, 27 nt, Artificial Sequence
  Description of Artificial Sequence: Synthetic oligonucleotide
  Description of Combined DNA/RNA Molecule: Synthetic oligonucleotide
aguggauuaccacagcugaccaguuau

SEQ ID NO: 1404 - RNA, 27 nt, Artificial Sequence
  Description of Artificial Sequence: Synthetic oligonucleotide
  Description of Combined DNA/RNA Molecule: Synthetic oligonucleotide
aagcagucuauuuauauuuucuacauc

SEQ ID NO: 1405 - RNA, 27 nt, Artificial Sequence
  Description of Artificial Sequence: Synthetic oligonucleotide
  Description of Combined DNA/RNA Molecule: Synthetic oligonucleotide
uugauuuucucccuucaacaaacagaa

SEQ ID NO: 1406 - RNA, 27 nt, Artificial Sequence
  Description of Artificial Sequence: Synthetic oligonucleotide
  Description of Combined DNA/RNA Molecule: Synthetic oligonucleotide
aauuacucagagcuuuggaucaaguua

SEQ ID NO: 1407 - RNA, 27 nt, Artificial Sequence
  Description of Artificial Sequence: Synthetic oligonucleotide
  Description of Combined DNA/RNA Molecule: Synthetic oligonucleotide
uugaguaauuuuagaagcauuauuuua

SEQ ID NO: 1408 - RNA, 27 nt, Artificial Sequence
  Description of Artificial Sequence: Synthetic oligonucleotide
  Description of Combined DNA/RNA Molecule: Synthetic oligonucleotide
ucuaauuuuagaagccuggcuacaaua

SEQ ID NO: 1409 - RNA, 27 nt, Artificial Sequence
  Description of Artificial Sequence: Synthetic oligonucleotide
  Description of Combined DNA/RNA Molecule: Synthetic oligonucleotide
uuaugcacuuugucgcuauuaacaucc

SEQ ID NO: 1410 - RNA, 27 nt, Artificial Sequence
  Description of Artificial Sequence: Synthetic oligonucleotide
  Description of Combined DNA/RNA Molecule: Synthetic oligonucleotide
ggcagcagaaaccuacugcagggugaa

SEQ ID NO: 1411 - RNA, 27 nt, Artificial Sequence
  Description of Artificial Sequence: Synthetic oligonucleotide
  Description of Combined DNA/RNA Molecule: Synthetic oligonucleotide
gaagaauuacucagagcuuuggaucaa

SEQ ID NO: 1412 - RNA, 27 nt, Artificial Sequence
  Description of Artificial Sequence: Synthetic oligonucleotide
  Description of Combined DNA/RNA Molecule: Synthetic oligonucleotide
gugaagaauuacucagagcuuuggauc

SEQ ID NO: 1413 - RNA, 27 nt, Artificial Sequence
  Description of Artificial Sequence: Synthetic oligonucleotide
  Description of Combined DNA/RNA Molecule: Synthetic oligonucleotide
uuacucagagcuuuggaucaaguuaac

SEQ ID NO: 1414 - RNA, 27 nt, Artificial Sequence
  Description of Artificial Sequence: Synthetic oligonucleotide
  Description of Combined DNA/RNA Molecule: Synthetic oligonucleotide
cagcacccaacgcgcgcgcccgcgggc

SEQ ID NO: 1415 - RNA, 27 nt, Artificial Sequence
  Description of Artificial Sequence: Synthetic oligonucleotide
  Description of Combined DNA/RNA Molecule: Synthetic oligonucleotide
cucagcacccaacgcgcgcgcccgcgg

SEQ ID NO: 1416 - RNA, 27 nt, Artificial Sequence
  Description of Artificial Sequence: Synthetic oligonucleotide
  Description of Combined DNA/RNA Molecule: Synthetic oligonucleotide
gcucagcacccaacgcgcgcgcccgcg

SEQ ID NO: 1417 - RNA, 27 nt, Artificial Sequence
  Description of Artificial Sequence: Synthetic oligonucleotide
  Description of Combined DNA/RNA Molecule: Synthetic oligonucleotide
cgcucagcacccaacgcgcgcgcccgc

SEQ ID NO: 1418 - RNA, 27 nt, Artificial Sequence
  Description of Artificial Sequence: Synthetic oligonucleotide
  Description of Combined DNA/RNA Molecule: Synthetic oligonucleotide
ccgcucagcacccaacgcgcgcgcccg

SEQ ID NO: 1419 - RNA, 27 nt, Artificial Sequence
  Description of Artificial Sequence: Synthetic oligonucleotide
  Description of Combined DNA/RNA Molecule: Synthetic oligonucleotide
cccgcucagcacccaacgcgcgcgccc

SEQ ID NO: 1420 - RNA, 27 nt, Artificial Sequence
  Description of Artificial Sequence: Synthetic oligonucleotide
  Description of Combined DNA/RNA Molecule: Synthetic oligonucleotide
gcccgcucagcacccaacgcgcgcgcc

SEQ ID NO: 1421 - RNA, 27 nt, Artificial Sequence
  Description of Artificial Sequence: Synthetic oligonucleotide
  Description of Combined DNA/RNA Molecule: Synthetic oligonucleotide
cgcccgcucagcacccaacgcgcgcgc

SEQ ID NO: 1422 - RNA, 27 nt, Artificial Sequence
  Description of Artificial Sequence: Synthetic oligonucleotide
  Description of Combined DNA/RNA Molecule: Synthetic oligonucleotide
gcgcccgcucagcacccaacgcgcgcg

SEQ ID NO: 1423 - RNA, 27 nt, Artificial Sequence
  Description of Artificial Sequence: Synthetic oligonucleotide
  Description of Combined DNA/RNA Molecule: Synthetic oligonucleotide
gcgcgcccgcucagcacccaacgcgcg

SEQ ID NO: 1424 - RNA, 27 nt, Artificial Sequence
  Description of Artificial Sequence: Synthetic oligonucleotide
  Description of Combined DNA/RNA Molecule: Synthetic oligonucleotide
cgcgcgcccgcucagcacccaacgcgc

SEQ ID NO: 1425 - RNA, 27 nt, Artificial Sequence
  Description of Artificial Sequence: Synthetic oligonucleotide
  Description of Combined DNA/RNA Molecule: Synthetic oligonucleotide
gcgcgcgcccgcucagcacccaacgcg

SEQ ID NO: 1426 - RNA, 27 nt, Artificial Sequence
  Description of Artificial Sequence: Synthetic oligonucleotide
  Description of Combined DNA/RNA Molecule: Synthetic oligonucleotide
ugcgcgcgcccgcucagcacccaacgc

SEQ ID NO: 1427 - RNA, 27 nt, Artificial Sequence
  Description of Artificial Sequence: Synthetic oligonucleotide
  Description of Combined DNA/RNA Molecule: Synthetic oligonucleotide
gugcgcgcgcccgcucagcacccaacg

SEQ ID NO: 1428 - RNA, 27 nt, Artificial Sequence
  Description of Artificial Sequence: Synthetic oligonucleotide
  Description of Combined DNA/RNA Molecule: Synthetic oligonucleotide
gggugcgcgcgcccgcucagcacccaa

SEQ ID NO: 1429 - RNA, 27 nt, Artificial Sequence
  Description of Artificial Sequence: Synthetic oligonucleotide
  Description of Combined DNA/RNA Molecule: Synthetic oligonucleotide
gaggcgcgcucgggcgcgcggcgaggg

SEQ ID NO: 1430 - RNA, 27 nt, Artificial Sequence
  Description of Artificial Sequence: Synthetic oligonucleotide
  Description of Combined DNA/RNA Molecule: Synthetic oligonucleotide
ggaggcgcgcucgggcgcgcggcgagg

SEQ ID NO: 1431 - RNA, 27 nt, Artificial Sequence
  Description of Artificial Sequence: Synthetic oligonucleotide
  Description of Combined DNA/RNA Molecule: Synthetic oligonucleotide
cggaggcgcgcucgggcgcgcggcgag

SEQ ID NO: 1432 - RNA, 27 nt, Artificial Sequence
  Description of Artificial Sequence: Synthetic oligonucleotide
  Description of Combined DNA/RNA Molecule: Synthetic oligonucleotide
gcggaggcgcgcucgggcgcgcggcga

SEQ ID NO: 1433 - RNA, 27 nt, Artificial Sequence
  Description of Artificial Sequence: Synthetic oligonucleotide
  Description of Combined DNA/RNA Molecule: Synthetic oligonucleotide
gcacugaggcgcugaagcagcggcagg

SEQ ID NO: 1434 - RNA, 27 nt, Artificial Sequence
  Description of Artificial Sequence: Synthetic oligonucleotide
  Description of Combined DNA/RNA Molecule: Synthetic oligonucleotide
gugcacugaggcgcugaagcagcggca

SEQ ID NO: 1435 - RNA, 27 nt, Artificial Sequence
  Description of Artificial Sequence: Synthetic oligonucleotide
  Description of Combined DNA/RNA Molecule: Synthetic oligonucleotide
cucugugcacugaggcgcugaagcagc

SEQ ID NO: 1436 - RNA, 27 nt, Artificial Sequence
  Description of Artificial Sequence: Synthetic oligonucleotide
  Description of Combined DNA/RNA Molecule: Synthetic oligonucleotide
gcucugugcacugaggcgcugaagcag

SEQ ID NO: 1437 - RNA, 27 nt, Artificial Sequence
  Description of Artificial Sequence: Synthetic oligonucleotide
  Description of Combined DNA/RNA Molecule: Synthetic oligonucleotide
aggcucugugcacugaggcgcugaagc

SEQ ID NO: 1438 - RNA, 27 nt, Artificial Sequence
  Description of Artificial Sequence: Synthetic oligonucleotide
  Description of Combined DNA/RNA Molecule: Synthetic oligonucleotide
gaggaggcucugugcacugaggcgcug

SEQ ID NO: 1439 - RNA, 27 nt, Artificial Sequence
  Description of Artificial Sequence: Synthetic oligonucleotide
  Description of Combined DNA/RNA Molecule: Synthetic oligonucleotide
caggcugcgcucgcugagcuccggcuc

SEQ ID NO: 1440 - RNA, 27 nt, Artificial Sequence
  Description of Artificial Sequence: Synthetic oligonucleotide
  Description of Combined DNA/RNA Molecule: Synthetic oligonucleotide
gagcugcaggcugcgcucgcugagcuc

SEQ ID NO: 1441 - RNA, 27 nt, Artificial Sequence
  Description of Artificial Sequence: Synthetic oligonucleotide
  Description of Combined DNA/RNA Molecule: Synthetic oligonucleotide
ggcgggagcugcaggcugcgcucgcug

SEQ ID NO: 1442 - RNA, 27 nt, Artificial Sequence
  Description of Artificial Sequence: Synthetic oligonucleotide
  Description of Combined DNA/RNA Molecule: Synthetic oligonucleotide
aggcgggagcugcaggcugcgcucgcu

SEQ ID NO: 1443 - RNA, 27 nt, Artificial Sequence
  Description of Artificial Sequence: Synthetic oligonucleotide
  Description of Combined DNA/RNA Molecule: Synthetic oligonucleotide
gaggcgggagcugcaggcugcgcucgc

SEQ ID NO: 1444 - RNA, 27 nt, Artificial Sequence
  Description of Artificial Sequence: Synthetic oligonucleotide
  Description of Combined DNA/RNA Molecule: Synthetic oligonucleotide
gcgaggcgggagcugcaggcugcgcuc

SEQ ID NO: 1445 - RNA, 27 nt, Artificial Sequence
  Description of Artificial Sequence: Synthetic oligonucleotide
  Description of Combined DNA/RNA Molecule: Synthetic oligonucleotide
acggcgaggcgggagcugcaggcugcg

SEQ ID NO: 1446 - RNA, 27 nt, Artificial Sequence
  Description of Artificial Sequence: Synthetic oligonucleotide
  Description of Combined DNA/RNA Molecule: Synthetic oligonucleotide
gcgcgcgcggagaaagagacaagucca

SEQ ID NO: 1447 - RNA, 27 nt, Artificial Sequence
  Description of Artificial Sequence: Synthetic oligonucleotide
  Description of Combined DNA/RNA Molecule: Synthetic oligonucleotide
ccgcgcgcgcggagaaagagacaaguc

SEQ ID NO: 1448 - RNA, 27 nt, Artificial Sequence
  Description of Artificial Sequence: Synthetic oligonucleotide
  Description of Combined DNA/RNA Molecule: Synthetic oligonucleotide
guccgcgcgcgcggagaaagagacaag

SEQ ID NO: 1449 - RNA, 27 nt, Artificial Sequence
  Description of Artificial Sequence: Synthetic oligonucleotide
  Description of Combined DNA/RNA Molecule: Synthetic oligonucleotide
uguccgcgcgcgcggagaaagagacaa

SEQ ID NO: 1450 - RNA, 27 nt, Artificial Sequence
  Description of Artificial Sequence: Synthetic oligonucleotide
  Description of Combined DNA/RNA Molecule: Synthetic oligonucleotide
cuguccgcgcgcgcggagaaagagaca

SEQ ID NO: 1451 - RNA, 27 nt, Artificial Sequence
  Description of Artificial Sequence: Synthetic oligonucleotide
  Description of Combined DNA/RNA Molecule: Synthetic oligonucleotide
gcucuguccgcgcgcgcggagaaagag

SEQ ID NO: 1452 - RNA, 27 nt, Artificial Sequence
  Description of Artificial Sequence: Synthetic oligonucleotide
  Description of Combined DNA/RNA Molecule: Synthetic oligonucleotide
cggcucuguccgcgcgcgcggagaaag

SEQ ID NO: 1453 - RNA, 27 nt, Artificial Sequence
  Description of Artificial Sequence: Synthetic oligonucleotide
  Description of Combined DNA/RNA Molecule: Synthetic oligonucleotide
aaacgccggcucuguccgcgcgcgcgg

SEQ ID NO: 1454 - RNA, 27 nt, Artificial Sequence
  Description of Artificial Sequence: Synthetic oligonucleotide
  Description of Combined DNA/RNA Molecule: Synthetic oligonucleotide
agaagcuuuaucaagaugugagcucac

SEQ ID NO: 1455 - RNA, 27 nt, Artificial Sequence
  Description of Artificial Sequence: Synthetic oligonucleotide
  Description of Combined DNA/RNA Molecule: Synthetic oligonucleotide
aacagaagcuuuaucaagaugugagcu

SEQ ID NO: 1456 - RNA, 27 nt, Artificial Sequence
  Description of Artificial Sequence: Synthetic oligonucleotide
  Description of Combined DNA/RNA Molecule: Synthetic oligonucleotide
cuagggcuuucagauaaaaacagucca

SEQ ID NO: 1457 - RNA, 27 nt, Artificial Sequence
  Description of Artificial Sequence: Synthetic oligonucleotide
  Description of Combined DNA/RNA Molecule: Synthetic oligonucleotide
aaaucagcaccaagcacgucaugggug

SEQ ID NO: 1458 - RNA, 27 nt, Artificial Sequence
  Description of Artificial Sequence: Synthetic oligonucleotide
  Description of Combined DNA/RNA Molecule: Synthetic oligonucleotide
aagcuuaucaaaaaggcagcuuguauc

SEQ ID NO: 1459 - RNA, 27 nt, Artificial Sequence
  Description of Artificial Sequence: Synthetic oligonucleotide
  Description of Combined DNA/RNA Molecule: Synthetic oligonucleotide
uuaagcuuaucaaaaaggcagcuugua

SEQ ID NO: 1460 - RNA, 27 nt, Artificial Sequence
  Description of Artificial Sequence: Synthetic oligonucleotide
  Description of Combined DNA/RNA Molecule: Synthetic oligonucleotide
cuuaagcuuaucaaaaaggcagcuugu

SEQ ID NO: 1461 - RNA, 27 nt, Artificial Sequence
  Description of Artificial Sequence: Synthetic oligonucleotide
  Description of Combined DNA/RNA Molecule: Synthetic oligonucleotide
cuucuuaagcuuaucaaaaaggcagcu

SEQ ID NO: 1462 - RNA, 27 nt, Artificial Sequence
  Description of Artificial Sequence: Synthetic oligonucleotide
  Description of Combined DNA/RNA Molecule: Synthetic oligonucleotide
agcuggagccagcagagugagagcauc

SEQ ID NO: 1463 - RNA, 27 nt, Artificial Sequence
  Description of Artificial Sequence: Synthetic oligonucleotide
  Description of Combined DNA/RNA Molecule: Synthetic oligonucleotide
cagcuggagccagcagagugagagcau

SEQ ID NO: 1464 - RNA, 27 nt, Artificial Sequence
  Description of Artificial Sequence: Synthetic oligonucleotide
  Description of Combined DNA/RNA Molecule: Synthetic oligonucleotide
gcagcuggagccagcagagugagagca

SEQ ID NO: 1465 - RNA, 27 nt, Artificial Sequence
  Description of Artificial Sequence: Synthetic oligonucleotide
  Description of Combined DNA/RNA Molecule: Synthetic oligonucleotide
ugucgccggcagcuggagccagcagag

SEQ ID NO: 1466 - RNA, 27 nt, Artificial Sequence
  Description of Artificial Sequence: Synthetic oligonucleotide
  Description of Combined DNA/RNA Molecule: Synthetic oligonucleotide
cagugcaggaucagcacuacuucgaag

SEQ ID NO: 1467 - RNA, 27 nt, Artificial Sequence
  Description of Artificial Sequence: Synthetic oligonucleotide
  Description of Combined DNA/RNA Molecule: Synthetic oligonucleotide
uaucgcuauccacaucaaagcaauauu

SEQ ID NO: 1468 - RNA, 27 nt, Artificial Sequence
  Description of Artificial Sequence: Synthetic oligonucleotide
  Description of Combined DNA/RNA Molecule: Synthetic oligonucleotide
cauaucgcuauccacaucaaagcaaua

SEQ ID NO: 1469 - RNA, 27 nt, Artificial Sequence
  Description of Artificial Sequence: Synthetic oligonucleotide
  Description of Combined DNA/RNA Molecule: Synthetic oligonucleotide
accauaucgcuauccacaucaaagcaa

SEQ ID NO: 1470 - RNA, 27 nt, Artificial Sequence
  Description of Artificial Sequence: Synthetic oligonucleotide
  Description of Combined DNA/RNA Molecule: Synthetic oligonucleotide
cugcugcuugaaaaagggagccaucau

SEQ ID NO: 1471 - RNA, 27 nt, Artificial Sequence
  Description of Artificial Sequence: Synthetic oligonucleotide
  Description of Combined DNA/RNA Molecule: Synthetic oligonucleotide
caguguccaaaaauaaccaacagaaac

SEQ ID NO: 1472 - RNA, 27 nt, Artificial Sequence
  Description of Artificial Sequence: Synthetic oligonucleotide
  Description of Combined DNA/RNA Molecule: Synthetic oligonucleotide
caacagcuucaugauccaggcuuaaca

SEQ ID NO: 1473 - RNA, 27 nt, Artificial Sequence
  Description of Artificial Sequence: Synthetic oligonucleotide
  Description of Combined DNA/RNA Molecule: Synthetic oligonucleotide
aagaucaacagcuucaugauccaggcu

SEQ ID NO: 1474 - RNA, 27 nt, Artificial Sequence
  Description of Artificial Sequence: Synthetic oligonucleotide
  Description of Combined DNA/RNA Molecule: Synthetic oligonucleotide
uuaagaaucauuauaagaucaacagcu

SEQ ID NO: 1475 - RNA, 27 nt, Artificial Sequence
  Description of Artificial Sequence: Synthetic oligonucleotide
  Description of Combined DNA/RNA Molecule: Synthetic oligonucleotide
aaagaaaccauacaguuuaagaaucau

SEQ ID NO: 1476 - RNA, 27 nt, Artificial Sequence
  Description of Artificial Sequence: Synthetic oligonucleotide
  Description of Combined DNA/RNA Molecule: Synthetic oligonucleotide
cuuuacccauauaaagaaaccauacag

SEQ ID NO: 1477 - RNA, 27 nt, Artificial Sequence
  Description of Artificial Sequence: Synthetic oligonucleotide
  Description of Combined DNA/RNA Molecule: Synthetic oligonucleotide
cauagaaaaaacaagauguuuacuaug

SEQ ID NO: 1478 - RNA, 27 nt, Artificial Sequence
  Description of Artificial Sequence: Synthetic oligonucleotide
  Description of Combined DNA/RNA Molecule: Synthetic oligonucleotide
caaccacaaagagcaagggaacgaaaa

SEQ ID NO: 1479 - RNA, 27 nt, Artificial Sequence
  Description of Artificial Sequence: Synthetic oligonucleotide
  Description of Combined DNA/RNA Molecule: Synthetic oligonucleotide
ccaaccacaaagagcaagggaacgaaa

SEQ ID NO: 1480 - RNA, 27 nt, Artificial Sequence
  Description of Artificial Sequence: Synthetic oligonucleotide
  Description of Combined DNA/RNA Molecule: Synthetic oligonucleotide
uagacccaaccacaaagagcaagggaa

SEQ ID NO: 1481 - RNA, 27 nt, Artificial Sequence
  Description of Artificial Sequence: Synthetic oligonucleotide
  Description of Combined DNA/RNA Molecule: Synthetic oligonucleotide
ccacauagcucccugagagcgcggaaa

SEQ ID NO: 1482 - RNA, 27 nt, Artificial Sequence
  Description of Artificial Sequence: Synthetic oligonucleotide
  Description of Combined DNA/RNA Molecule: Synthetic oligonucleotide
agcuggcaaaguaaagaaacaucaggu

SEQ ID NO: 1483 - RNA, 27 nt, Artificial Sequence
  Description of Artificial Sequence: Synthetic oligonucleotide
  Description of Combined DNA/RNA Molecule: Synthetic oligonucleotide
aagcuggcaaaguaaagaaacaucagg

SEQ ID NO: 1484 - RNA, 27 nt, Artificial Sequence
  Description of Artificial Sequence: Synthetic oligonucleotide
  Description of Combined DNA/RNA Molecule: Synthetic oligonucleotide
aaagcuggcaaaguaaagaaacaucag

SEQ ID NO: 1485 - RNA, 27 nt, Artificial Sequence
  Description of Artificial Sequence: Synthetic oligonucleotide
  Description of Combined DNA/RNA Molecule: Synthetic oligonucleotide
cauaagauacuuuuuuaaagcuggcaa

SEQ ID NO: 1486 - DNA, 25 bp, Artificial Sequence
  Description of Artificial Sequence: Synthetic oligonucleotide
  Description of Combined DNA/RNA Molecule: Synthetic oligonucleotide
ccgcgggcgcgcgcguugggugctg

SEQ ID NO: 1487 - DNA, 25 bp, Artificial Sequence
  Description of Artificial Sequence: Synthetic oligonucleotide
  Description of Combined DNA/RNA Molecule: Synthetic oligonucleotide
gcgggcgcgcgcguugggugcugag

SEQ ID NO: 1488 - DNA, 25 bp, Artificial Sequence
  Description of Artificial Sequence: Synthetic oligonucleotide
  Description of Combined DNA/RNA Molecule: Synthetic oligonucleotide
cgggcgcgcgcguugggugcugagc

SEQ ID NO: 1489 - DNA, 25 bp, Artificial Sequence
  Description of Artificial Sequence: Synthetic oligonucleotide
  Description of Combined DNA/RNA Molecule: Synthetic oligonucleotide
gggcgcgcgcguugggugcugagcg

SEQ ID NO: 1490 - DNA, 25 bp, Artificial Sequence
  Description of Artificial Sequence: Synthetic oligonucleotide
  Description of Combined DNA/RNA Molecule: Synthetic oligonucleotide
ggcgcgcgcguugggugcugagcgg

SEQ ID NO: 1491 - DNA, 25 bp, Artificial Sequence
  Description of Artificial Sequence: Synthetic oligonucleotide
  Description of Combined DNA/RNA Molecule: Synthetic oligonucleotide
gcgcgcgcguugggugcugagcggg

SEQ ID NO: 1492 - DNA, 25 bp, Artificial Sequence
  Description of Artificial Sequence: Synthetic oligonucleotide
  Description of Combined DNA/RNA Molecule: Synthetic oligonucleotide
cgcgcgcguugggugcugagcgggc

SEQ ID NO: 1493 - DNA, 25 bp, Artificial Sequence
  Description of Artificial Sequence: Synthetic oligonucleotide
  Description of Combined DNA/RNA Molecule: Synthetic oligonucleotide
gcgcgcguugggugcugagcgggcg

SEQ ID NO: 1494 - DNA, 25 bp, Artificial Sequence
  Description of Artificial Sequence: Synthetic oligonucleotide
  Description of Combined DNA/RNA Molecule: Synthetic oligonucleotide
cgcgcguugggugcugagcgggcgc

SEQ ID NO: 1495 - DNA, 25 bp, Artificial Sequence
  Description of Artificial Sequence: Synthetic oligonucleotide
  Description of Combined DNA/RNA Molecule: Synthetic oligonucleotide
cgcguugggugcugagcgggcgcgc

SEQ ID NO: 1496 - DNA, 25 bp, Artificial Sequence
  Description of Artificial Sequence: Synthetic oligonucleotide
  Description of Combined DNA/RNA Molecule: Synthetic oligonucleotide
gcguugggugcugagcgggcgcgcg

SEQ ID NO: 1497 - DNA, 25 bp, Artificial Sequence
  Description of Artificial Sequence: Synthetic oligonucleotide
  Description of Combined DNA/RNA Molecule: Synthetic oligonucleotide
cguugggugcugagcgggcgcgcgc

SEQ ID NO: 1498 - DNA, 25 bp, Artificial Sequence
  Description of Artificial Sequence: Synthetic oligonucleotide
  Description of Combined DNA/RNA Molecule: Synthetic oligonucleotide
guugggugcugagcgggcgcgcgca

SEQ ID NO: 1499 - DNA, 25 bp, Artificial Sequence
  Description of Artificial Sequence: Synthetic oligonucleotide
  Description of Combined DNA/RNA Molecule: Synthetic oligonucleotide
uugggugcugagcgggcgcgcgcac

SEQ ID NO: 1500 - DNA, 25 bp, Artificial Sequence
  Description of Artificial Sequence: Synthetic oligonucleotide
  Description of Combined DNA/RNA Molecule: Synthetic oligonucleotide
gggugcugagcgggcgcgcgcaccc

SEQ ID NO: 1501 - DNA, 25 bp, Artificial Sequence
  Description of Artificial Sequence: Synthetic oligonucleotide
  Description of Combined DNA/RNA Molecule: Synthetic oligonucleotide
cucgccgcgcgcccgagcgcgcctc

SEQ ID NO: 1502 - DNA, 25 bp, Artificial Sequence
  Description of Artificial Sequence: Synthetic oligonucleotide
  Description of Combined DNA/RNA Molecule: Synthetic oligonucleotide
ucgccgcgcgcccgagcgcgccucc

SEQ ID NO: 1503 - DNA, 25 bp, Artificial Sequence
  Description of Artificial Sequence: Synthetic oligonucleotide
  Description of Combined DNA/RNA Molecule: Synthetic oligonucleotide
cgccgcgcgcccgagcgcgccuccg

SEQ ID NO: 1504 - DNA, 25 bp, Artificial Sequence
  Description of Artificial Sequence: Synthetic oligonucleotide
  Description of Combined DNA/RNA Molecule: Synthetic oligonucleotide
gccgcgcgcccgagcgcgccuccgc

SEQ ID NO: 1505 - DNA, 25 bp, Artificial Sequence
  Description of Artificial Sequence: Synthetic oligonucleotide
  Description of Combined DNA/RNA Molecule: Synthetic oligonucleotide
ugccgcugcuucagcgccucagugc

SEQ ID NO: 1506 - DNA, 25 bp, Artificial Sequence
  Description of Artificial Sequence: Synthetic oligonucleotide
  Description of Combined DNA/RNA Molecule: Synthetic oligonucleotide
ccgcugcuucagcgccucagugcac

SEQ ID NO: 1507 - DNA, 25 bp, Artificial Sequence
  Description of Artificial Sequence: Synthetic oligonucleotide
  Description of Combined DNA/RNA Molecule: Synthetic oligonucleotide
ugcuucagcgccucagugcacagag

SEQ ID NO: 1508 - DNA, 25 bp, Artificial Sequence
  Description of Artificial Sequence: Synthetic oligonucleotide
  Description of Combined DNA/RNA Molecule: Synthetic oligonucleotide
gcuucagcgccucagugcacagagc

SEQ ID NO: 1509 - DNA, 25 bp, Artificial Sequence
  Description of Artificial Sequence: Synthetic oligonucleotide
  Description of Combined DNA/RNA Molecule: Synthetic oligonucleotide
uucagcgccucagugcacagagcct

SEQ ID NO: 1510 - DNA, 25 bp, Artificial Sequence
  Description of Artificial Sequence: Synthetic oligonucleotide
  Description of Combined DNA/RNA Molecule: Synthetic oligonucleotide
gcgccucagugcacagagccucctc

SEQ ID NO: 1511 - DNA, 25 bp, Artificial Sequence
  Description of Artificial Sequence: Synthetic oligonucleotide
  Description of Combined DNA/RNA Molecule: Synthetic oligonucleotide
gccggagcucagcgagcgcagcctg

SEQ ID NO: 1512 - DNA, 25 bp, Artificial Sequence
  Description of Artificial Sequence: Synthetic oligonucleotide
  Description of Combined DNA/RNA Molecule: Synthetic oligonucleotide
gcucagcgagcgcagccugcagctc

SEQ ID NO: 1513 - DNA, 25 bp, Artificial Sequence
  Description of Artificial Sequence: Synthetic oligonucleotide
  Description of Combined DNA/RNA Molecule: Synthetic oligonucleotide
gcgagcgcagccugcagcucccgcc

SEQ ID NO: 1514 - DNA, 25 bp, Artificial Sequence
  Description of Artificial Sequence: Synthetic oligonucleotide
  Description of Combined DNA/RNA Molecule: Synthetic oligonucleotide
cgagcgcagccugcagcucccgcct

SEQ ID NO: 1515 - DNA, 25 bp, Artificial Sequence
  Description of Artificial Sequence: Synthetic oligonucleotide
  Description of Combined DNA/RNA Molecule: Synthetic oligonucleotide
gagcgcagccugcagcucccgcctc

SEQ ID NO: 1516 - DNA, 25 bp, Artificial Sequence
  Description of Artificial Sequence: Synthetic oligonucleotide
  Description of Combined DNA/RNA Molecule: Synthetic oligonucleotide
gcgcagccugcagcucccgccucgc

SEQ ID NO: 1517 - DNA, 25 bp, Artificial Sequence
  Description of Artificial Sequence: Synthetic oligonucleotide
  Description of Combined DNA/RNA Molecule: Synthetic oligonucleotide
cagccugcagcucccgccucgccgt

SEQ ID NO: 1518 - DNA, 25 bp, Artificial Sequence
  Description of Artificial Sequence: Synthetic oligonucleotide
  Description of Combined DNA/RNA Molecule: Synthetic oligonucleotide
gacuugucucuuucuccgcgcgcgc

SEQ ID NO: 1519 - DNA, 25 bp, Artificial Sequence
  Description of Artificial Sequence: Synthetic oligonucleotide
  Description of Combined DNA/RNA Molecule: Synthetic oligonucleotide
cuugucucuuucuccgcgcgcgcgg

SEQ ID NO: 1520 - DNA, 25 bp, Artificial Sequence
  Description of Artificial Sequence: Synthetic oligonucleotide
  Description of Combined DNA/RNA Molecule: Synthetic oligonucleotide
ugucucuuucuccgcgcgcgcggac

SEQ ID NO: 1521 - DNA, 25 bp, Artificial Sequence
  Description of Artificial Sequence: Synthetic oligonucleotide
  Description of Combined DNA/RNA Molecule: Synthetic oligonucleotide
gucucuuucuccgcgcgcgcggaca

SEQ ID NO: 1522 - DNA, 25 bp, Artificial Sequence
  Description of Artificial Sequence: Synthetic oligonucleotide
  Description of Combined DNA/RNA Molecule: Synthetic oligonucleotide
ucucuuucuccgcgcgcgcggacag

SEQ ID NO: 1523 - DNA, 25 bp, Artificial Sequence
  Description of Artificial Sequence: Synthetic oligonucleotide
  Description of Combined DNA/RNA Molecule: Synthetic oligonucleotide
cuuucuccgcgcgcgcggacagagc

SEQ ID NO: 1524 - DNA, 25 bp, Artificial Sequence
  Description of Artificial Sequence: Synthetic oligonucleotide
  Description of Combined DNA/RNA Molecule: Synthetic oligonucleotide
uucuccgcgcgcgcggacagagccg

SEQ ID NO: 1525 - DNA, 25 bp, Artificial Sequence
  Description of Artificial Sequence: Synthetic oligonucleotide
  Description of Combined DNA/RNA Molecule: Synthetic oligonucleotide
gcgcgcgcggacagagccggcgutt

SEQ ID NO: 1526 - DNA, 25 bp, Artificial Sequence
  Description of Artificial Sequence: Synthetic oligonucleotide
  Description of Combined DNA/RNA Molecule: Synthetic oligonucleotide
gagcucacaucuugauaaagcuuct

SEQ ID NO: 1527 - DNA, 25 bp, Artificial Sequence
  Description of Artificial Sequence: Synthetic oligonucleotide
  Description of Combined DNA/RNA Molecule: Synthetic oligonucleotide
cucacaucuugauaaagcuucugtt

SEQ ID NO: 1528 - DNA, 25 bp, Artificial Sequence
  Description of Artificial Sequence: Synthetic oligonucleotide
  Description of Combined DNA/RNA Molecule: Synthetic oligonucleotide
gacuguuuuuaucugaaagcccuag

SEQ ID NO: 1529 - DNA, 25 bp, Artificial Sequence
  Description of Artificial Sequence: Synthetic oligonucleotide
  Description of Combined DNA/RNA Molecule: Synthetic oligonucleotide
cccaugacgugcuuggugcugautt

SEQ ID NO: 1530 - DNA, 25 bp, Artificial Sequence
  Description of Artificial Sequence: Synthetic oligonucleotide
  Description of Combined DNA/RNA Molecule: Synthetic oligonucleotide
uacaagcugccuuuuugauaagctt

SEQ ID NO: 1531 - DNA, 25 bp, Artificial Sequence
  Description of Artificial Sequence: Synthetic oligonucleotide
  Description of Combined DNA/RNA Molecule: Synthetic oligonucleotide
caagcugccuuuuugauaagcuuaa

SEQ ID NO: 1532 - DNA, 25 bp, Artificial Sequence
  Description of Artificial Sequence: Synthetic oligonucleotide
  Description of Combined DNA/RNA Molecule: Synthetic oligonucleotide
aagcugccuuuuugauaagcuuaag

SEQ ID NO: 1533 - DNA, 25 bp, Artificial Sequence
  Description of Artificial Sequence: Synthetic oligonucleotide
  Description of Combined DNA/RNA Molecule: Synthetic oligonucleotide
cugccuuuuugauaagcuuaagaag

SEQ ID NO: 1534 - DNA, 25 bp, Artificial Sequence
  Description of Artificial Sequence: Synthetic oligonucleotide
  Description of Combined DNA/RNA Molecule: Synthetic oligonucleotide
ugcucucacucugcuggcuccagct

SEQ ID NO: 1535 - DNA, 25 bp, Artificial Sequence
  Description of Artificial Sequence: Synthetic oligonucleotide
  Description of Combined DNA/RNA Molecule: Synthetic oligonucleotide
gcucucacucugcuggcuccagctg

SEQ ID NO: 1536 - DNA, 25 bp, Artificial Sequence
  Description of Artificial Sequence: Synthetic oligonucleotide
  Description of Combined DNA/RNA Molecule: Synthetic oligonucleotide
cucucacucugcuggcuccagcugc

SEQ ID NO: 1537 - DNA, 25 bp, Artificial Sequence
  Description of Artificial Sequence: Synthetic oligonucleotide
  Description of Combined DNA/RNA Molecule: Synthetic oligonucleotide
cugcuggcuccagcugccggcgaca

SEQ ID NO: 1538 - DNA, 25 bp, Artificial Sequence
  Description of Artificial Sequence: Synthetic oligonucleotide
  Description of Combined DNA/RNA Molecule: Synthetic oligonucleotide
ucgaaguagugcugauccugcactg

SEQ ID NO: 1539 - DNA, 25 bp, Artificial Sequence
  Description of Artificial Sequence: Synthetic oligonucleotide
  Description of Combined DNA/RNA Molecule: Synthetic oligonucleotide
uauugcuuugauguggauagcgata

SEQ ID NO: 1540 - DNA, 25 bp, Artificial Sequence
  Description of Artificial Sequence: Synthetic oligonucleotide
  Description of Combined DNA/RNA Molecule: Synthetic oligonucleotide
uugcuuugauguggauagcgauatg

SEQ ID NO: 1541 - DNA, 25 bp, Artificial Sequence
  Description of Artificial Sequence: Synthetic oligonucleotide
  Description of Combined DNA/RNA Molecule: Synthetic oligonucleotide
gcuuugauguggauagcgauauggt

SEQ ID NO: 1542 - DNA, 25 bp, Artificial Sequence
  Description of Artificial Sequence: Synthetic oligonucleotide
  Description of Combined DNA/RNA Molecule: Synthetic oligonucleotide
gauggcucccuuuuucaagcagcag

SEQ ID NO: 1543 - DNA, 25 bp, Artificial Sequence
  Description of Artificial Sequence: Synthetic oligonucleotide
  Description of Combined DNA/RNA Molecule: Synthetic oligonucleotide
uucuguugguuauuuuuggacactg

SEQ ID NO: 1544 - DNA, 25 bp, Artificial Sequence
  Description of Artificial Sequence: Synthetic oligonucleotide
  Description of Combined DNA/RNA Molecule: Synthetic oligonucleotide
uuaagccuggaucaugaagcugutg

SEQ ID NO: 1545 - DNA, 25 bp, Artificial Sequence
  Description of Artificial Sequence: Synthetic oligonucleotide
  Description of Combined DNA/RNA Molecule: Synthetic oligonucleotide
ccuggaucaugaagcuguugauctt

SEQ ID NO: 1546 - DNA, 25 bp, Artificial Sequence
  Description of Artificial Sequence: Synthetic oligonucleotide
  Description of Combined DNA/RNA Molecule: Synthetic oligonucleotide
cuguugaucuuauaaugauucuuaa

SEQ ID NO: 1547 - DNA, 25 bp, Artificial Sequence
  Description of Artificial Sequence: Synthetic oligonucleotide
  Description of Combined DNA/RNA Molecule: Synthetic oligonucleotide
gauucuuaaacuguaugguuucutt

SEQ ID NO: 1548 - DNA, 25 bp, Artificial Sequence
  Description of Artificial Sequence: Synthetic oligonucleotide
  Description of Combined DNA/RNA Molecule: Synthetic oligonucleotide
guaugguuucuuuauauggguaaag

SEQ ID NO: 1549 - DNA, 25 bp, Artificial Sequence
  Description of Artificial Sequence: Synthetic oligonucleotide
  Description of Combined DNA/RNA Molecule: Synthetic oligonucleotide
uaguaaacaucuuguuuuuucuatg

SEQ ID NO: 1550 - DNA, 25 bp, Artificial Sequence
  Description of Artificial Sequence: Synthetic oligonucleotide
  Description of Combined DNA/RNA Molecule: Synthetic oligonucleotide
uucguucccuugcucuuuguggutg

SEQ ID NO: 1551 - DNA, 25 bp, Artificial Sequence
  Description of Artificial Sequence: Synthetic oligonucleotide
  Description of Combined DNA/RNA Molecule: Synthetic oligonucleotide
ucguucccuugcucuuugugguugg

SEQ ID NO: 1552 - DNA, 25 bp, Artificial Sequence
  Description of Artificial Sequence: Synthetic oligonucleotide
  Description of Combined DNA/RNA Molecule: Synthetic oligonucleotide
cccuugcucuuugugguugggucta

SEQ ID NO: 1553 - DNA, 25 bp, Artificial Sequence
  Description of Artificial Sequence: Synthetic oligonucleotide
  Description of Combined DNA/RNA Molecule: Synthetic oligonucleotide
uccgcgcucucagggagcuaugugg

SEQ ID NO: 1554 - DNA, 25 bp, Artificial Sequence
  Description of Artificial Sequence: Synthetic oligonucleotide
  Description of Combined DNA/RNA Molecule: Synthetic oligonucleotide
cugauguuucuuuacuuugccagct

SEQ ID NO: 1555 - DNA, 25 bp, Artificial Sequence
  Description of Artificial Sequence: Synthetic oligonucleotide
  Description of Combined DNA/RNA Molecule: Synthetic oligonucleotide
ugauguuucuuuacuuugccagctt

SEQ ID NO: 1556 - DNA, 25 bp, Artificial Sequence
  Description of Artificial Sequence: Synthetic oligonucleotide
  Description of Combined DNA/RNA Molecule: Synthetic oligonucleotide
gauguuucuuuacuuugccagcutt

SEQ ID NO: 1557 - DNA, 25 bp, Artificial Sequence
  Description of Artificial Sequence: Synthetic oligonucleotide
  Description of Combined DNA/RNA Molecule: Synthetic oligonucleotide
gccagcuuuaaaaaaguaucuuatg

SEQ ID NO: 1558 - DNA, 27 bp, Artificial Sequence
  Description of Artificial Sequence: Synthetic oligonucleotide
  Description of Combined DNA/RNA Molecule: Synthetic oligonucleotide
gcccgcgggcgcgcgcgttgggtgctg

SEQ ID NO: 1559 - DNA, 27 bp, Artificial Sequence
  Description of Artificial Sequence: Synthetic oligonucleotide
  Description of Combined DNA/RNA Molecule: Synthetic oligonucleotide
ccgcgggcgcgcgcgttgggtgctgag

SEQ ID NO: 1560 - DNA, 27 bp, Artificial Sequence
  Description of Artificial Sequence: Synthetic oligonucleotide
  Description of Combined DNA/RNA Molecule: Synthetic oligonucleotide
cgcgggcgcgcgcgttgggtgctgagc

SEQ ID NO: 1561 - DNA, 27 bp, Artificial Sequence
  Description of Artificial Sequence: Synthetic oligonucleotide
  Description of Combined DNA/RNA Molecule: Synthetic oligonucleotide
gcgggcgcgcgcgttgggtgctgagcg

SEQ ID NO: 1562 - DNA, 27 bp, Artificial Sequence
  Description of Artificial Sequence: Synthetic oligonucleotide
  Description of Combined DNA/RNA Molecule: Synthetic oligonucleotide
cgggcgcgcgcgttgggtgctgagcgg

SEQ ID NO: 1563 - DNA, 27 bp, Artificial Sequence
  Description of Artificial Sequence: Synthetic oligonucleotide
  Description of Combined DNA/RNA Molecule: Synthetic oligonucleotide
gggcgcgcgcgttgggtgctgagcggg

SEQ ID NO: 1564 - DNA, 27 bp, Artificial Sequence
  Description of Artificial Sequence: Synthetic oligonucleotide
  Description of Combined DNA/RNA Molecule: Synthetic oligonucleotide
ggcgcgcgcgttgggtgctgagcgggc

SEQ ID NO: 1565 - DNA, 27 bp, Artificial Sequence
  Description of Artificial Sequence: Synthetic oligonucleotide
  Description of Combined DNA/RNA Molecule: Synthetic oligonucleotide
gcgcgcgcgttgggtgctgagcgggcg

SEQ ID NO: 1566 - DNA, 27 bp, Artificial Sequence
  Description of Artificial Sequence: Synthetic oligonucleotide
  Description of Combined DNA/RNA Molecule: Synthetic oligonucleotide
cgcgcgcgttgggtgctgagcgggcgc

SEQ ID NO: 1567 - DNA, 27 bp, Artificial Sequence
  Description of Artificial Sequence: Synthetic oligonucleotide
  Description of Combined DNA/RNA Molecule: Synthetic oligonucleotide
cgcgcgttgggtgctgagcgggcgcgc

SEQ ID NO: 1568 - DNA, 27 bp, Artificial Sequence
  Description of Artificial Sequence: Synthetic oligonucleotide
  Description of Combined DNA/RNA Molecule: Synthetic oligonucleotide
gcgcgttgggtgctgagcgggcgcgcg

SEQ ID NO: 1569 - DNA, 27 bp, Artificial Sequence
  Description of Artificial Sequence: Synthetic oligonucleotide
  Description of Combined DNA/RNA Molecule: Synthetic oligonucleotide
cgcgttgggtgctgagcgggcgcgcgc

SEQ ID NO: 1570 - DNA, 27 bp, Artificial Sequence
  Description of Artificial Sequence: Synthetic oligonucleotide
  Description of Combined DNA/RNA Molecule: Synthetic oligonucleotide
gcgttgggtgctgagcgggcgcgcgca

SEQ ID NO: 1571 - DNA, 27 bp, Artificial Sequence
  Description of Artificial Sequence: Synthetic oligonucleotide
  Description of Combined DNA/RNA Molecule: Synthetic oligonucleotide
cgttgggtgctgagcgggcgcgcgcac

SEQ ID NO: 1572 - DNA, 27 bp, Artificial Sequence
  Description of Artificial Sequence: Synthetic oligonucleotide
  Description of Combined DNA/RNA Molecule: Synthetic oligonucleotide
ttgggtgctgagcgggcgcgcgcaccc

SEQ ID NO: 1573 - DNA, 27 bp, Artificial Sequence
  Description of Artificial Sequence: Synthetic oligonucleotide
  Description of Combined DNA/RNA Molecule: Synthetic oligonucleotide
ccctcgccgcgcgcccgagcgcgcctc

SEQ ID NO: 1574 - DNA, 27 bp, Artificial Sequence
  Description of Artificial Sequence: Synthetic oligonucleotide
  Description of Combined DNA/RNA Molecule: Synthetic oligonucleotide
cctcgccgcgcgcccgagcgcgcctcc

SEQ ID NO: 1575 - DNA, 27 bp, Artificial Sequence
  Description of Artificial Sequence: Synthetic oligonucleotide
  Description of Combined DNA/RNA Molecule: Synthetic oligonucleotide
ctcgccgcgcgcccgagcgcgcctccg

SEQ ID NO: 1576 - DNA, 27 bp, Artificial Sequence
  Description of Artificial Sequence: Synthetic oligonucleotide
  Description of Combined DNA/RNA Molecule: Synthetic oligonucleotide
tcgccgcgcgcccgagcgcgcctccgc

SEQ ID NO: 1577 - DNA, 27 bp, Artificial Sequence
  Description of Artificial Sequence: Synthetic oligonucleotide
  Description of Combined DNA/RNA Molecule: Synthetic oligonucleotide
cctgccgctgcttcagcgcctcagtgc

SEQ ID NO: 1578 - DNA, 27 bp, Artificial Sequence
  Description of Artificial Sequence: Synthetic oligonucleotide
  Description of Combined DNA/RNA Molecule: Synthetic oligonucleotide
tgccgctgcttcagcgcctcagtgcac

SEQ ID NO: 1579 - DNA, 27 bp, Artificial Sequence
  Description of Artificial Sequence: Synthetic oligonucleotide
  Description of Combined DNA/RNA Molecule: Synthetic oligonucleotide
gctgcttcagcgcctcagtgcacagag

SEQ ID NO: 1580 - DNA, 27 bp, Artificial Sequence
  Description of Artificial Sequence: Synthetic oligonucleotide
  Description of Combined DNA/RNA Molecule: Synthetic oligonucleotide
ctgcttcagcgcctcagtgcacagagc

SEQ ID NO: 1581 - DNA, 27 bp, Artificial Sequence
  Description of Artificial Sequence: Synthetic oligonucleotide
  Description of Combined DNA/RNA Molecule: Synthetic oligonucleotide
gcttcagcgcctcagtgcacagagcct

SEQ ID NO: 1582 - DNA, 27 bp, Artificial Sequence
  Description of Artificial Sequence: Synthetic oligonucleotide
  Description of Combined DNA/RNA Molecule: Synthetic oligonucleotide
cagcgcctcagtgcacagagcctcctc

SEQ ID NO: 1583 - DNA, 27 bp, Artificial Sequence
  Description of Artificial Sequence: Synthetic oligonucleotide
  Description of Combined DNA/RNA Molecule: Synthetic oligonucleotide
gagccggagctcagcgagcgcagcctg

SEQ ID NO: 1584 - DNA, 27 bp, Artificial Sequence
  Description of Artificial Sequence: Synthetic oligonucleotide
  Description of Combined DNA/RNA Molecule: Synthetic oligonucleotide
gagctcagcgagcgcagcctgcagctc

SEQ ID NO: 1585 - DNA, 27 bp, Artificial Sequence
  Description of Artificial Sequence: Synthetic oligonucleotide
  Description of Combined DNA/RNA Molecule: Synthetic oligonucleotide
cagcgagcgcagcctgcagctcccgcc

SEQ ID NO: 1586 - DNA, 27 bp, Artificial Sequence
  Description of Artificial Sequence: Synthetic oligonucleotide
  Description of Combined DNA/RNA Molecule: Synthetic oligonucleotide
agcgagcgcagcctgcagctcccgcct

SEQ ID NO: 1587 - DNA, 27 bp, Artificial Sequence
  Description of Artificial Sequence: Synthetic oligonucleotide
  Description of Combined DNA/RNA Molecule: Synthetic oligonucleotide
gcgagcgcagcctgcagctcccgcctc

SEQ ID NO: 1588 - DNA, 27 bp, Artificial Sequence
  Description of Artificial Sequence: Synthetic oligonucleotide
  Description of Combined DNA/RNA Molecule: Synthetic oligonucleotide
gagcgcagcctgcagctcccgcctcgc

SEQ ID NO: 1589 - DNA, 27 bp, Artificial Sequence
  Description of Artificial Sequence: Synthetic oligonucleotide
  Description of Combined DNA/RNA Molecule: Synthetic oligonucleotide
cgcagcctgcagctcccgcctcgccgt

SEQ ID NO: 1590 - DNA, 27 bp, Artificial Sequence
  Description of Artificial Sequence: Synthetic oligonucleotide
  Description of Combined DNA/RNA Molecule: Synthetic oligonucleotide
tggacttgtctctttctccgcgcgcgc

SEQ ID NO: 1591 - DNA, 27 bp, Artificial Sequence
  Description of Artificial Sequence: Synthetic oligonucleotide
  Description of Combined DNA/RNA Molecule: Synthetic oligonucleotide
gacttgtctctttctccgcgcgcgcgg

SEQ ID NO: 1592 - DNA, 27 bp, Artificial Sequence
  Description of Artificial Sequence: Synthetic oligonucleotide
  Description of Combined DNA/RNA Molecule: Synthetic oligonucleotide
cttgtctctttctccgcgcgcgcggac

SEQ ID NO: 1593 - DNA, 27 bp, Artificial Sequence
  Description of Artificial Sequence: Synthetic oligonucleotide
  Description of Combined DNA/RNA Molecule: Synthetic oligonucleotide
ttgtctctttctccgcgcgcgcggaca

SEQ ID NO: 1594 - DNA, 27 bp, Artificial Sequence
  Description of Artificial Sequence: Synthetic oligonucleotide
  Description of Combined DNA/RNA Molecule: Synthetic oligonucleotide
tgtctctttctccgcgcgcgcggacag

SEQ ID NO: 1595 - DNA, 27 bp, Artificial Sequence
  Description of Artificial Sequence: Synthetic oligonucleotide
  Description of Combined DNA/RNA Molecule: Synthetic oligonucleotide
ctctttctccgcgcgcgcggacagagc

SEQ ID NO: 1596 - DNA, 27 bp, Artificial Sequence
  Description of Artificial Sequence: Synthetic oligonucleotide
  Description of Combined DNA/RNA Molecule: Synthetic oligonucleotide
ctttctccgcgcgcgcggacagagccg

SEQ ID NO: 1597 - DNA, 27 bp, Artificial Sequence
  Description of Artificial Sequence: Synthetic oligonucleotide
  Description of Combined DNA/RNA Molecule: Synthetic oligonucleotide
ccgcgcgcgcggacagagccggcgttt

SEQ ID NO: 1598 - DNA, 27 bp, Artificial Sequence
  Description of Artificial Sequence: Synthetic oligonucleotide
  Description of Combined DNA/RNA Molecule: Synthetic oligonucleotide
gtgagctcacatcttgataaagcttct

SEQ ID NO: 1599 - DNA, 27 bp, Artificial Sequence
  Description of Artificial Sequence: Synthetic oligonucleotide
  Description of Combined DNA/RNA Molecule: Synthetic oligonucleotide
agctcacatcttgataaagcttctgtt

SEQ ID NO: 1600 - DNA, 27 bp, Artificial Sequence
  Description of Artificial Sequence: Synthetic oligonucleotide
  Description of Combined DNA/RNA Molecule: Synthetic oligonucleotide
tggactgtttttatctgaaagccctag

SEQ ID NO: 1601 - DNA, 27 bp, Artificial Sequence
  Description of Artificial Sequence: Synthetic oligonucleotide
  Description of Combined DNA/RNA Molecule: Synthetic oligonucleotide
cacccatgacgtgcttggtgctgattt

SEQ ID NO: 1602 - DNA, 27 bp, Artificial Sequence
  Description of Artificial Sequence: Synthetic oligonucleotide
  Description of Combined DNA/RNA Molecule: Synthetic oligonucleotide
gatacaagctgcctttttgataagctt

SEQ ID NO: 1603 - DNA, 27 bp, Artificial Sequence
  Description of Artificial Sequence: Synthetic oligonucleotide
  Description of Combined DNA/RNA Molecule: Synthetic oligonucleotide
tacaagctgcctttttgataagcttaa

SEQ ID NO: 1604 - DNA, 27 bp, Artificial Sequence
  Description of Artificial Sequence: Synthetic oligonucleotide
  Description of Combined DNA/RNA Molecule: Synthetic oligonucleotide
acaagctgcctttttgataagcttaag

SEQ ID NO: 1605 - DNA, 27 bp, Artificial Sequence
  Description of Artificial Sequence: Synthetic oligonucleotide
  Description of Combined DNA/RNA Molecule: Synthetic oligonucleotide
agctgcctttttgataagcttaagaag

SEQ ID NO: 1606 - DNA, 27 bp, Artificial Sequence
  Description of Artificial Sequence: Synthetic oligonucleotide
  Description of Combined DNA/RNA Molecule: Synthetic oligonucleotide
gatgctctcactctgctggctccagct

SEQ ID NO: 1607 - DNA, 27 bp, Artificial Sequence
  Description of Artificial Sequence: Synthetic oligonucleotide
  Description of Combined DNA/RNA Molecule: Synthetic oligonucleotide
atgctctcactctgctggctccagctg

SEQ ID NO: 1608 - DNA, 27 bp, Artificial Sequence
  Description of Artificial Sequence: Synthetic oligonucleotide
  Description of Combined DNA/RNA Molecule: Synthetic oligonucleotide
tgctctcactctgctggctccagctgc

SEQ ID NO: 1609 - DNA, 27 bp, Artificial Sequence
  Description of Artificial Sequence: Synthetic oligonucleotide
  Description of Combined DNA/RNA Molecule: Synthetic oligonucleotide
ctctgctggctccagctgccggcgaca

SEQ ID NO: 1610 - DNA, 27 bp, Artificial Sequence
  Description of Artificial Sequence: Synthetic oligonucleotide
  Description of Combined DNA/RNA Molecule: Synthetic oligonucleotide
cttcgaagtagtgctgatcctgcactg

SEQ ID NO: 1611 - DNA, 27 bp, Artificial Sequence
  Description of Artificial Sequence: Synthetic oligonucleotide
  Description of Combined DNA/RNA Molecule: Synthetic oligonucleotide
aatattgctttgatgtggatagcgata

SEQ ID NO: 1612 - DNA, 27 bp, Artificial Sequence
  Description of Artificial Sequence: Synthetic oligonucleotide
  Description of Combined DNA/RNA Molecule: Synthetic oligonucleotide
tattgctttgatgtggatagcgatatg

SEQ ID NO: 1613 - DNA, 27 bp, Artificial Sequence
  Description of Artificial Sequence: Synthetic oligonucleotide
  Description of Combined DNA/RNA Molecule: Synthetic oligonucleotide
ttgctttgatgtggatagcgatatggt

SEQ ID NO: 1614 - DNA, 27 bp, Artificial Sequence
  Description of Artificial Sequence: Synthetic oligonucleotide
  Description of Combined DNA/RNA Molecule: Synthetic oligonucleotide
atgatggctccctttttcaagcagcag

SEQ ID NO: 1615 - DNA, 27 bp, Artificial Sequence
  Description of Artificial Sequence: Synthetic oligonucleotide
  Description of Combined DNA/RNA Molecule: Synthetic oligonucleotide
gtttctgttggttatttttggacactg

SEQ ID NO: 1616 - DNA, 27 bp, Artificial Sequence
  Description of Artificial Sequence: Synthetic oligonucleotide
  Description of Combined DNA/RNA Molecule: Synthetic oligonucleotide
tgttaagcctggatcatgaagctgttg

SEQ ID NO: 1617 - DNA, 27 bp, Artificial Sequence
  Description of Artificial Sequence: Synthetic oligonucleotide
  Description of Combined DNA/RNA Molecule: Synthetic oligonucleotide
agcctggatcatgaagctgttgatctt

SEQ ID NO: 1618 - DNA, 27 bp, Artificial Sequence
  Description of Artificial Sequence: Synthetic oligonucleotide
  Description of Combined DNA/RNA Molecule: Synthetic oligonucleotide
agctgttgatcttataatgattcttaa

SEQ ID NO: 1619 - DNA, 27 bp, Artificial Sequence
  Description of Artificial Sequence: Synthetic oligonucleotide
  Description of Combined DNA/RNA Molecule: Synthetic oligonucleotide
atgattcttaaactgtatggtttcttt

SEQ ID NO: 1620 - DNA, 27 bp, Artificial Sequence
  Description of Artificial Sequence: Synthetic oligonucleotide
  Description of Combined DNA/RNA Molecule: Synthetic oligonucleotide
ctgtatggtttctttatatgggtaaag

SEQ ID NO: 1621 - DNA, 27 bp, Artificial Sequence
  Description of Artificial Sequence: Synthetic oligonucleotide
  Description of Combined DNA/RNA Molecule: Synthetic oligonucleotide
catagtaaacatcttgttttttctatg

SEQ ID NO: 1622 - DNA, 27 bp, Artificial Sequence
  Description of Artificial Sequence: Synthetic oligonucleotide
  Description of Combined DNA/RNA Molecule: Synthetic oligonucleotide
ttttcgttcccttgctctttgtggttg

SEQ ID NO: 1623 - DNA, 27 bp, Artificial Sequence
  Description of Artificial Sequence: Synthetic oligonucleotide
  Description of Combined DNA/RNA Molecule: Synthetic oligonucleotide
tttcgttcccttgctctttgtggttgg

SEQ ID NO: 1624 - DNA, 27 bp, Artificial Sequence
  Description of Artificial Sequence: Synthetic oligonucleotide
  Description of Combined DNA/RNA Molecule: Synthetic oligonucleotide
ttcccttgctctttgtggttgggtcta

SEQ ID NO: 1625 - DNA, 27 bp, Artificial Sequence
  Description of Artificial Sequence: Synthetic oligonucleotide
  Description of Combined DNA/RNA Molecule: Synthetic oligonucleotide
tttccgcgctctcagggagctatgtgg

SEQ ID NO: 1626 - DNA, 27 bp, Artificial Sequence
  Description of Artificial Sequence: Synthetic oligonucleotide
  Description of Combined DNA/RNA Molecule: Synthetic oligonucleotide
acctgatgtttctttactttgccagct

SEQ ID NO: 1627 - DNA, 27 bp, Artificial Sequence
  Description of Artificial Sequence: Synthetic oligonucleotide
  Description of Combined DNA/RNA Molecule: Synthetic oligonucleotide
cctgatgtttctttactttgccagctt

SEQ ID NO: 1628 - DNA, 27 bp, Artificial Sequence
  Description of Artificial Sequence: Synthetic oligonucleotide
  Description of Combined DNA/RNA Molecule: Synthetic oligonucleotide
ctgatgtttctttactttgccagcttt

SEQ ID NO: 1629 - DNA, 27 bp, Artificial Sequence
  Description of Artificial Sequence: Synthetic oligonucleotide
  Description of Combined DNA/RNA Molecule: Synthetic oligonucleotide
ttgccagctttaaaaaagtatcttatg

SEQ ID NO: 1630 - RNA, 21 nt, Artificial Sequence
  Description of Artificial Sequence: Synthetic oligonucleotide
  Description of Combined DNA/RNA Molecule: Synthetic oligonucleotide
ccgcgcgcccgagcgcgccuc

SEQ ID NO: 1631 - RNA, 21 nt, Artificial Sequence
  Description of Artificial Sequence: Synthetic oligonucleotide
  Description of Combined DNA/RNA Molecule: Synthetic oligonucleotide
gcgcgcccgagcgcgccuccg

SEQ ID NO: 1632 - RNA, 21 nt, Artificial Sequence
  Description of Artificial Sequence: Synthetic oligonucleotide
  Description of Combined DNA/RNA Molecule: Synthetic oligonucleotide
gcgcccgagcgcgccuccgcc

SEQ ID NO: 1633 - RNA, 21 nt, Artificial Sequence
  Description of Artificial Sequence: Synthetic oligonucleotide
  Description of Combined DNA/RNA Molecule: Synthetic oligonucleotide
gcccgagcgcgccuccgcccu

SEQ ID NO: 1634 - RNA, 21 nt, Artificial Sequence
  Description of Artificial Sequence: Synthetic oligonucleotide
  Description of Combined DNA/RNA Molecule: Synthetic oligonucleotide
ccgagcgcgccuccgcccuug

SEQ ID NO: 1635 - RNA, 21 nt, Artificial Sequence
  Description of Artificial Sequence: Synthetic oligonucleotide
  Description of Combined DNA/RNA Molecule: Synthetic oligonucleotide
gcugccucagcuccucagugc

SEQ ID NO: 1636 - RNA, 21 nt, Artificial Sequence
  Description of Artificial Sequence: Synthetic oligonucleotide
  Description of Combined DNA/RNA Molecule: Synthetic oligonucleotide
cugccucagcuccucagugca

SEQ ID NO: 1637 - RNA, 21 nt, Artificial Sequence
  Description of Artificial Sequence: Synthetic oligonucleotide
  Description of Combined DNA/RNA Molecule: Synthetic oligonucleotide
gccucagcuccucagugcaca

SEQ ID NO: 1638 - RNA, 21 nt, Artificial Sequence
  Description of Artificial Sequence: Synthetic oligonucleotide
  Description of Combined DNA/RNA Molecule: Synthetic oligonucleotide
cagcuccucagugcacagugc

SEQ ID NO: 1639 - RNA, 21 nt, Artificial Sequence
  Description of Artificial Sequence: Synthetic oligonucleotide
  Description of Combined DNA/RNA Molecule: Synthetic oligonucleotide
agcuccucagugcacagugcu

SEQ ID NO: 1640 - RNA, 21 nt, Artificial Sequence
  Description of Artificial Sequence: Synthetic oligonucleotide
  Description of Combined DNA/RNA Molecule: Synthetic oligonucleotide
gugcugccucgucugagggga

SEQ ID NO: 1641 - RNA, 21 nt, Artificial Sequence
  Description of Artificial Sequence: Synthetic oligonucleotide
  Description of Combined DNA/RNA Molecule: Synthetic oligonucleotide
gauugccgcccgcuucucucu

SEQ ID NO: 1642 - RNA, 21 nt, Artificial Sequence
  Description of Artificial Sequence: Synthetic oligonucleotide
  Description of Combined DNA/RNA Molecule: Synthetic oligonucleotide
uugccgcccgcuucucucuag

SEQ ID NO: 1643 - RNA, 21 nt, Artificial Sequence
  Description of Artificial Sequence: Synthetic oligonucleotide
  Description of Combined DNA/RNA Molecule: Synthetic oligonucleotide
ugccgcccgcuucucucuagu

SEQ ID NO: 1644 - RNA, 21 nt, Artificial Sequence
  Description of Artificial Sequence: Synthetic oligonucleotide
  Description of Combined DNA/RNA Molecule: Synthetic oligonucleotide
acgagggguuucccgccucgc

SEQ ID NO: 1645 - RNA, 21 nt, Artificial Sequence
  Description of Artificial Sequence: Synthetic oligonucleotide
  Description of Combined DNA/RNA Molecule: Synthetic oligonucleotide
accucuggacuugccuuuccu

SEQ ID NO: 1646 - RNA, 21 nt, Artificial Sequence
  Description of Artificial Sequence: Synthetic oligonucleotide
  Description of Combined DNA/RNA Molecule: Synthetic oligonucleotide
ucuggacuugccuuuccuucu

SEQ ID NO: 1647 - RNA, 21 nt, Artificial Sequence
  Description of Artificial Sequence: Synthetic oligonucleotide
  Description of Combined DNA/RNA Molecule: Synthetic oligonucleotide
uggacuugccuuuccuucucu

SEQ ID NO: 1648 - RNA, 21 nt, Artificial Sequence
  Description of Artificial Sequence: Synthetic oligonucleotide
  Description of Combined DNA/RNA Molecule: Synthetic oligonucleotide
acuugccuuuccuucucuucu

SEQ ID NO: 1649 - RNA, 21 nt, Artificial Sequence
  Description of Artificial Sequence: Synthetic oligonucleotide
  Description of Combined DNA/RNA Molecule: Synthetic oligonucleotide
uugccuuuccuucucuucucc

SEQ ID NO: 1650 - RNA, 21 nt, Artificial Sequence
  Description of Artificial Sequence: Synthetic oligonucleotide
  Description of Combined DNA/RNA Molecule: Synthetic oligonucleotide
ugccuuuccuucucuucuccg

SEQ ID NO: 1651 - RNA, 21 nt, Artificial Sequence
  Description of Artificial Sequence: Synthetic oligonucleotide
  Description of Combined DNA/RNA Molecule: Synthetic oligonucleotide
gccuuuccuucucuucuccgc

SEQ ID NO: 1652 - RNA, 21 nt, Artificial Sequence
  Description of Artificial Sequence: Synthetic oligonucleotide
  Description of Combined DNA/RNA Molecule: Synthetic oligonucleotide
ucuucuccgcguguggaggga

SEQ ID NO: 1653 - RNA, 21 nt, Artificial Sequence
  Description of Artificial Sequence: Synthetic oligonucleotide
  Description of Combined DNA/RNA Molecule: Synthetic oligonucleotide
uucuccgcguguggagggagc

SEQ ID NO: 1654 - RNA, 21 nt, Artificial Sequence
  Description of Artificial Sequence: Synthetic oligonucleotide
  Description of Combined DNA/RNA Molecule: Synthetic oligonucleotide
cuccgcguguggagggagcca

SEQ ID NO: 1655 - RNA, 21 nt, Artificial Sequence
  Description of Artificial Sequence: Synthetic oligonucleotide
  Description of Combined DNA/RNA Molecule: Synthetic oligonucleotide
gggagccagcgcuuaggccgg

SEQ ID NO: 1656 - RNA, 21 nt, Artificial Sequence
  Description of Artificial Sequence: Synthetic oligonucleotide
  Description of Combined DNA/RNA Molecule: Synthetic oligonucleotide
gugaagacaucgcggggaccg

SEQ ID NO: 1657 - RNA, 21 nt, Artificial Sequence
  Description of Artificial Sequence: Synthetic oligonucleotide
  Description of Combined DNA/RNA Molecule: Synthetic oligonucleotide
cgauucaccauggagggcgcc

SEQ ID NO: 1658 - RNA, 21 nt, Artificial Sequence
  Description of Artificial Sequence: Synthetic oligonucleotide
  Description of Combined DNA/RNA Molecule: Synthetic oligonucleotide
caccauggagggcgccggcgg

SEQ ID NO: 1659 - RNA, 21 nt, Artificial Sequence
  Description of Artificial Sequence: Synthetic oligonucleotide
  Description of Combined DNA/RNA Molecule: Synthetic oligonucleotide
ccauggagggcgccggcggcg

SEQ ID NO: 1660 - RNA, 21 nt, Artificial Sequence
  Description of Artificial Sequence: Synthetic oligonucleotide
  Description of Combined DNA/RNA Molecule: Synthetic oligonucleotide
cgcgaacgacaagaaaaagau

SEQ ID NO: 1661 - RNA, 21 nt, Artificial Sequence
  Description of Artificial Sequence: Synthetic oligonucleotide
  Description of Combined DNA/RNA Molecule: Synthetic oligonucleotide
gacaagaaaaagauaaguucu

SEQ ID NO: 1662 - RNA, 21 nt, Artificial Sequence
  Description of Artificial Sequence: Synthetic oligonucleotide
  Description of Combined DNA/RNA Molecule: Synthetic oligonucleotide
aaguucugaacgucgaaaaga

SEQ ID NO: 1663 - RNA, 21 nt, Artificial Sequence
  Description of Artificial Sequence: Synthetic oligonucleotide
  Description of Combined DNA/RNA Molecule: Synthetic oligonucleotide
guucugaacgucgaaaagaaa

SEQ ID NO: 1664 - RNA, 21 nt, Artificial Sequence
  Description of Artificial Sequence: Synthetic oligonucleotide
  Description of Combined DNA/RNA Molecule: Synthetic oligonucleotide
ucugaacgucgaaaagaaaag

SEQ ID NO: 1665 - RNA, 21 nt, Artificial Sequence
  Description of Artificial Sequence: Synthetic oligonucleotide
  Description of Combined DNA/RNA Molecule: Synthetic oligonucleotide
ugaacgucgaaaagaaaaguc

SEQ ID NO: 1666 - RNA, 21 nt, Artificial Sequence
  Description of Artificial Sequence: Synthetic oligonucleotide
  Description of Combined DNA/RNA Molecule: Synthetic oligonucleotide
aagaaucugaaguuuuuuaug

SEQ ID NO: 1667 - RNA, 21 nt, Artificial Sequence
  Description of Artificial Sequence: Synthetic oligonucleotide
  Description of Combined DNA/RNA Molecule: Synthetic oligonucleotide
aaucugaaguuuuuuaugagc

SEQ ID NO: 1668 - RNA, 21 nt, Artificial Sequence
  Description of Artificial Sequence: Synthetic oligonucleotide
  Description of Combined DNA/RNA Molecule: Synthetic oligonucleotide
ucugaaguuuuuuaugagcuu

SEQ ID NO: 1669 - RNA, 21 nt, Artificial Sequence
  Description of Artificial Sequence: Synthetic oligonucleotide
  Description of Combined DNA/RNA Molecule: Synthetic oligonucleotide
ugaaguuuuuuaugagcuugc

SEQ ID NO: 1670 - RNA, 21 nt, Artificial Sequence
  Description of Artificial Sequence: Synthetic oligonucleotide
  Description of Combined DNA/RNA Molecule: Synthetic oligonucleotide
aaguuuuuuaugagcuugcuc

SEQ ID NO: 1671 - RNA, 21 nt, Artificial Sequence
  Description of Artificial Sequence: Synthetic oligonucleotide
  Description of Combined DNA/RNA Molecule: Synthetic oligonucleotide
guuuuuuaugagcuugcucau

SEQ ID NO: 1672 - RNA, 21 nt, Artificial Sequence
  Description of Artificial Sequence: Synthetic oligonucleotide
  Description of Combined DNA/RNA Molecule: Synthetic oligonucleotide
uuuuuaugagcuugcucauca

SEQ ID NO: 1673 - RNA, 21 nt, Artificial Sequence
  Description of Artificial Sequence: Synthetic oligonucleotide
  Description of Combined DNA/RNA Molecule: Synthetic oligonucleotide
uuuaugagcuugcucaucagu

SEQ ID NO: 1674 - RNA, 21 nt, Artificial Sequence
  Description of Artificial Sequence: Synthetic oligonucleotide
  Description of Combined DNA/RNA Molecule: Synthetic oligonucleotide
uaugagcuugcucaucaguug

SEQ ID NO: 1675 - RNA, 21 nt, Artificial Sequence
  Description of Artificial Sequence: Synthetic oligonucleotide
  Description of Combined DNA/RNA Molecule: Synthetic oligonucleotide
ugagcuugcucaucaguugcc

SEQ ID NO: 1676 - RNA, 21 nt, Artificial Sequence
  Description of Artificial Sequence: Synthetic oligonucleotide
  Description of Combined DNA/RNA Molecule: Synthetic oligonucleotide
agcuugcucaucaguugccac

SEQ ID NO: 1677 - RNA, 21 nt, Artificial Sequence
  Description of Artificial Sequence: Synthetic oligonucleotide
  Description of Combined DNA/RNA Molecule: Synthetic oligonucleotide
cuugcucaucaguugccacuu

SEQ ID NO: 1678 - RNA, 21 nt, Artificial Sequence
  Description of Artificial Sequence: Synthetic oligonucleotide
  Description of Combined DNA/RNA Molecule: Synthetic oligonucleotide
ugcucaucaguugccacuucc

SEQ ID NO: 1679 - RNA, 21 nt, Artificial Sequence
  Description of Artificial Sequence: Synthetic oligonucleotide
  Description of Combined DNA/RNA Molecule: Synthetic oligonucleotide
gccacuuccacauaaugugag

SEQ ID NO: 1680 - RNA, 21 nt, Artificial Sequence
  Description of Artificial Sequence: Synthetic oligonucleotide
  Description of Combined DNA/RNA Molecule: Synthetic oligonucleotide
aacuucuggaugcuggugauu

SEQ ID NO: 1681 - RNA, 21 nt, Artificial Sequence
  Description of Artificial Sequence: Synthetic oligonucleotide
  Description of Combined DNA/RNA Molecule: Synthetic oligonucleotide
cuucuggaugcuggugauuug

SEQ ID NO: 1682 - RNA, 21 nt, Artificial Sequence
  Description of Artificial Sequence: Synthetic oligonucleotide
  Description of Combined DNA/RNA Molecule: Synthetic oligonucleotide
uucuggaugcuggugauuugg

SEQ ID NO: 1683 - RNA, 21 nt, Artificial Sequence
  Description of Artificial Sequence: Synthetic oligonucleotide
  Description of Combined DNA/RNA Molecule: Synthetic oligonucleotide
gauauugaagaugacaugaaa

SEQ ID NO: 1684 - RNA, 21 nt, Artificial Sequence
  Description of Artificial Sequence: Synthetic oligonucleotide
  Description of Combined DNA/RNA Molecule: Synthetic oligonucleotide
gaugaauugcuuuuauuugaa

SEQ ID NO: 1685 - RNA, 21 nt, Artificial Sequence
  Description of Artificial Sequence: Synthetic oligonucleotide
  Description of Combined DNA/RNA Molecule: Synthetic oligonucleotide
uugaaagccuuggaugguuuu

SEQ ID NO: 1686 - RNA, 21 nt, Artificial Sequence
  Description of Artificial Sequence: Synthetic oligonucleotide
  Description of Combined DNA/RNA Molecule: Synthetic oligonucleotide
aagccuuggaugguuuuguua

SEQ ID NO: 1687 - RNA, 21 nt, Artificial Sequence
  Description of Artificial Sequence: Synthetic oligonucleotide
  Description of Combined DNA/RNA Molecule: Synthetic oligonucleotide
gccuuggaugguuuuguuaug

SEQ ID NO: 1688 - RNA, 21 nt, Artificial Sequence
  Description of Artificial Sequence: Synthetic oligonucleotide
  Description of Combined DNA/RNA Molecule: Synthetic oligonucleotide
cuuggaugguuuuguuauggu

SEQ ID NO: 1689 - RNA, 21 nt, Artificial Sequence
  Description of Artificial Sequence: Synthetic oligonucleotide
  Description of Combined DNA/RNA Molecule: Synthetic oligonucleotide
uggaugguuuuguuaugguuc

SEQ ID NO: 1690 - RNA, 21 nt, Artificial Sequence
  Description of Artificial Sequence: Synthetic oligonucleotide
  Description of Combined DNA/RNA Molecule: Synthetic oligonucleotide
ugauuuacauuucugauaaug

SEQ ID NO: 1691 - RNA, 21 nt, Artificial Sequence
  Description of Artificial Sequence: Synthetic oligonucleotide
  Description of Combined DNA/RNA Molecule: Synthetic oligonucleotide
gggauuaacucaguuugaacu

SEQ ID NO: 1692 - RNA, 21 nt, Artificial Sequence
  Description of Artificial Sequence: Synthetic oligonucleotide
  Description of Combined DNA/RNA Molecule: Synthetic oligonucleotide
auuaacucaguuugaacuaac

SEQ ID NO: 1693 - RNA, 21 nt, Artificial Sequence
  Description of Artificial Sequence: Synthetic oligonucleotide
  Description of Combined DNA/RNA Molecule: Synthetic oligonucleotide
guguuugauuuuacucaucca

SEQ ID NO: 1694 - RNA, 21 nt, Artificial Sequence
  Description of Artificial Sequence: Synthetic oligonucleotide
  Description of Combined DNA/RNA Molecule: Synthetic oligonucleotide
guuugauuuuacucauccaug

SEQ ID NO: 1695 - RNA, 21 nt, Artificial Sequence
  Description of Artificial Sequence: Synthetic oligonucleotide
  Description of Combined DNA/RNA Molecule: Synthetic oligonucleotide
uugauuuuacucauccaugug

SEQ ID NO: 1696 - RNA, 21 nt, Artificial Sequence
  Description of Artificial Sequence: Synthetic oligonucleotide
  Description of Combined DNA/RNA Molecule: Synthetic oligonucleotide
gauuuuacucauccaugugac

SEQ ID NO: 1697 - RNA, 21 nt, Artificial Sequence
  Description of Artificial Sequence: Synthetic oligonucleotide
  Description of Combined DNA/RNA Molecule: Synthetic oligonucleotide
uuuuacucauccaugugacca

SEQ ID NO: 1698 - RNA, 21 nt, Artificial Sequence
  Description of Artificial Sequence: Synthetic oligonucleotide
  Description of Combined DNA/RNA Molecule: Synthetic oligonucleotide
uuacucauccaugugaccaug

SEQ ID NO: 1699 - RNA, 21 nt, Artificial Sequence
  Description of Artificial Sequence: Synthetic oligonucleotide
  Description of Combined DNA/RNA Molecule: Synthetic oligonucleotide
acucauccaugugaccaugag

SEQ ID NO: 1700 - RNA, 21 nt, Artificial Sequence
  Description of Artificial Sequence: Synthetic oligonucleotide
  Description of Combined DNA/RNA Molecule: Synthetic oligonucleotide
ucauccaugugaccaugagga

SEQ ID NO: 1701 - RNA, 21 nt, Artificial Sequence
  Description of Artificial Sequence: Synthetic oligonucleotide
  Description of Combined DNA/RNA Molecule: Synthetic oligonucleotide
auccaugugaccaugaggaaa

SEQ ID NO: 1702 - RNA, 21 nt, Artificial Sequence
  Description of Artificial Sequence: Synthetic oligonucleotide
  Description of Combined DNA/RNA Molecule: Synthetic oligonucleotide
ccaugugaccaugaggaaaug

SEQ ID NO: 1703 - RNA, 21 nt, Artificial Sequence
  Description of Artificial Sequence: Synthetic oligonucleotide
  Description of Combined DNA/RNA Molecule: Synthetic oligonucleotide
augugaccaugaggaaaugag

SEQ ID NO: 1704 - RNA, 21 nt, Artificial Sequence
  Description of Artificial Sequence: Synthetic oligonucleotide
  Description of Combined DNA/RNA Molecule: Synthetic oligonucleotide
gugaccaugaggaaaugagag

SEQ ID NO: 1705 - RNA, 21 nt, Artificial Sequence
  Description of Artificial Sequence: Synthetic oligonucleotide
  Description of Combined DNA/RNA Molecule: Synthetic oligonucleotide
gaccaugaggaaaugagagaa

SEQ ID NO: 1706 - RNA, 21 nt, Artificial Sequence
  Description of Artificial Sequence: Synthetic oligonucleotide
  Description of Combined DNA/RNA Molecule: Synthetic oligonucleotide
ccaugaggaaaugagagaaau

SEQ ID NO: 1707 - RNA, 21 nt, Artificial Sequence
  Description of Artificial Sequence: Synthetic oligonucleotide
  Description of Combined DNA/RNA Molecule: Synthetic oligonucleotide
augaggaaaugagagaaaugc

SEQ ID NO: 1708 - RNA, 21 nt, Artificial Sequence
  Description of Artificial Sequence: Synthetic oligonucleotide
  Description of Combined DNA/RNA Molecule: Synthetic oligonucleotide
agcgaagcuuuuuucucagaa

SEQ ID NO: 1709 - RNA, 21 nt, Artificial Sequence
  Description of Artificial Sequence: Synthetic oligonucleotide
  Description of Combined DNA/RNA Molecule: Synthetic oligonucleotide
aagcuuuuuucucagaaugaa

SEQ ID NO: 1710 - RNA, 21 nt, Artificial Sequence
  Description of Artificial Sequence: Synthetic oligonucleotide
  Description of Combined DNA/RNA Molecule: Synthetic oligonucleotide
gcuuuuuucucagaaugaagu

SEQ ID NO: 1711 - RNA, 21 nt, Artificial Sequence
  Description of Artificial Sequence: Synthetic oligonucleotide
  Description of Combined DNA/RNA Molecule: Synthetic oligonucleotide
uauaugauaccaacaguaacc

SEQ ID NO: 1712 - RNA, 21 nt, Artificial Sequence
  Description of Artificial Sequence: Synthetic oligonucleotide
  Description of Combined DNA/RNA Molecule: Synthetic oligonucleotide
uaugauaccaacaguaaccaa

SEQ ID NO: 1713 - RNA, 21 nt, Artificial Sequence
  Description of Artificial Sequence: Synthetic oligonucleotide
  Description of Combined DNA/RNA Molecule: Synthetic oligonucleotide
ugauaccaacaguaaccaacc

SEQ ID NO: 1714 - RNA, 21 nt, Artificial Sequence
  Description of Artificial Sequence: Synthetic oligonucleotide
  Description of Combined DNA/RNA Molecule: Synthetic oligonucleotide
auaccaacaguaaccaaccuc

SEQ ID NO: 1715 - RNA, 21 nt, Artificial Sequence
  Description of Artificial Sequence: Synthetic oligonucleotide
  Description of Combined DNA/RNA Molecule: Synthetic oligonucleotide
accaacaguaaccaaccucag

SEQ ID NO: 1716 - RNA, 21 nt, Artificial Sequence
  Description of Artificial Sequence: Synthetic oligonucleotide
  Description of Combined DNA/RNA Molecule: Synthetic oligonucleotide
caacaguaaccaaccucagug

SEQ ID NO: 1717 - RNA, 21 nt, Artificial Sequence
  Description of Artificial Sequence: Synthetic oligonucleotide
  Description of Combined DNA/RNA Molecule: Synthetic oligonucleotide
acaguaaccaaccucagugug

SEQ ID NO: 1718 - RNA, 21 nt, Artificial Sequence
  Description of Artificial Sequence: Synthetic oligonucleotide
  Description of Combined DNA/RNA Molecule: Synthetic oligonucleotide
aguaaccaaccucaguguggg

SEQ ID NO: 1719 - RNA, 21 nt, Artificial Sequence
  Description of Artificial Sequence: Synthetic oligonucleotide
  Description of Combined DNA/RNA Molecule: Synthetic oligonucleotide
uaaccaaccucagugugggua

SEQ ID NO: 1720 - RNA, 21 nt, Artificial Sequence
  Description of Artificial Sequence: Synthetic oligonucleotide
  Description of Combined DNA/RNA Molecule: Synthetic oligonucleotide
caccuaugaccugcuuggugc

SEQ ID NO: 1721 - RNA, 21 nt, Artificial Sequence
  Description of Artificial Sequence: Synthetic oligonucleotide
  Description of Combined DNA/RNA Molecule: Synthetic oligonucleotide
accuaugaccugcuuggugcu

SEQ ID NO: 1722 - RNA, 21 nt, Artificial Sequence
  Description of Artificial Sequence: Synthetic oligonucleotide
  Description of Combined DNA/RNA Molecule: Synthetic oligonucleotide
cuaugaccugcuuggugcuga

SEQ ID NO: 1723 - RNA, 21 nt, Artificial Sequence
  Description of Artificial Sequence: Synthetic oligonucleotide
  Description of Combined DNA/RNA Molecule: Synthetic oligonucleotide
cugcuuggugcugauuuguga

SEQ ID NO: 1724 - RNA, 21 nt, Artificial Sequence
  Description of Artificial Sequence: Synthetic oligonucleotide
  Description of Combined DNA/RNA Molecule: Synthetic oligonucleotide
gcuuggugcugauuugugaac

SEQ ID NO: 1725 - RNA, 21 nt, Artificial Sequence
  Description of Artificial Sequence: Synthetic oligonucleotide
  Description of Combined DNA/RNA Molecule: Synthetic oligonucleotide
uuggugcugauuugugaaccc

SEQ ID NO: 1726 - RNA, 21 nt, Artificial Sequence
  Description of Artificial Sequence: Synthetic oligonucleotide
  Description of Combined DNA/RNA Molecule: Synthetic oligonucleotide
ggugcugauuugugaacccau

SEQ ID NO: 1727 - RNA, 21 nt, Artificial Sequence
  Description of Artificial Sequence: Synthetic oligonucleotide
  Description of Combined DNA/RNA Molecule: Synthetic oligonucleotide
ugcugauuugugaacccauuc

SEQ ID NO: 1728 - RNA, 21 nt, Artificial Sequence
  Description of Artificial Sequence: Synthetic oligonucleotide
  Description of Combined DNA/RNA Molecule: Synthetic oligonucleotide
cugauuugugaacccauuccu

SEQ ID NO: 1729 - RNA, 21 nt, Artificial Sequence
  Description of Artificial Sequence: Synthetic oligonucleotide
  Description of Combined DNA/RNA Molecule: Synthetic oligonucleotide
gauuugugaacccauuccuca

SEQ ID NO: 1730 - RNA, 21 nt, Artificial Sequence
  Description of Artificial Sequence: Synthetic oligonucleotide
  Description of Combined DNA/RNA Molecule: Synthetic oligonucleotide
aucaaauauugaaauuccuuu

SEQ ID NO: 1731 - RNA, 21 nt, Artificial Sequence
  Description of Artificial Sequence: Synthetic oligonucleotide
  Description of Combined DNA/RNA Molecule: Synthetic oligonucleotide
caaauauugaaauuccuuuag

SEQ ID NO: 1732 - RNA, 21 nt, Artificial Sequence
  Description of Artificial Sequence: Synthetic oligonucleotide
  Description of Combined DNA/RNA Molecule: Synthetic oligonucleotide
aauauugaaauuccuuuagau

SEQ ID NO: 1733 - RNA, 21 nt, Artificial Sequence
  Description of Artificial Sequence: Synthetic oligonucleotide
  Description of Combined DNA/RNA Molecule: Synthetic oligonucleotide
uauugaaauuccuuuagauag

SEQ ID NO: 1734 - RNA, 21 nt, Artificial Sequence
  Description of Artificial Sequence: Synthetic oligonucleotide
  Description of Combined DNA/RNA Molecule: Synthetic oligonucleotide
uugaaauuccuuuagauagca

SEQ ID NO: 1735 - RNA, 21 nt, Artificial Sequence
  Description of Artificial Sequence: Synthetic oligonucleotide
  Description of Combined DNA/RNA Molecule: Synthetic oligonucleotide
gaaauuccuuuagauagcaag

SEQ ID NO: 1736 - RNA, 21 nt, Artificial Sequence
  Description of Artificial Sequence: Synthetic oligonucleotide
  Description of Combined DNA/RNA Molecule: Synthetic oligonucleotide
aauuccuuuagauagcaagac

SEQ ID NO: 1737 - RNA, 21 nt, Artificial Sequence
  Description of Artificial Sequence: Synthetic oligonucleotide
  Description of Combined DNA/RNA Molecule: Synthetic oligonucleotide
cacagccuggauaugaaauuu

SEQ ID NO: 1738 - RNA, 21 nt, Artificial Sequence
  Description of Artificial Sequence: Synthetic oligonucleotide
  Description of Combined DNA/RNA Molecule: Synthetic oligonucleotide
ggauaugaaauuuucuuauug

SEQ ID NO: 1739 - RNA, 21 nt, Artificial Sequence
  Description of Artificial Sequence: Synthetic oligonucleotide
  Description of Combined DNA/RNA Molecule: Synthetic oligonucleotide
aggccgcucaauuuaugaaua

SEQ ID NO: 1740 - RNA, 21 nt, Artificial Sequence
  Description of Artificial Sequence: Synthetic oligonucleotide
  Description of Combined DNA/RNA Molecule: Synthetic oligonucleotide
gccgcucaauuuaugaauauu

SEQ ID NO: 1741 - RNA, 21 nt, Artificial Sequence
  Description of Artificial Sequence: Synthetic oligonucleotide
  Description of Combined DNA/RNA Molecule: Synthetic oligonucleotide
cgcucaauuuaugaauauuau

SEQ ID NO: 1742 - RNA, 21 nt, Artificial Sequence
  Description of Artificial Sequence: Synthetic oligonucleotide
  Description of Combined DNA/RNA Molecule: Synthetic oligonucleotide
cucaauuuaugaauauuauca

SEQ ID NO: 1743 - RNA, 21 nt, Artificial Sequence
  Description of Artificial Sequence: Synthetic oligonucleotide
  Description of Combined DNA/RNA Molecule: Synthetic oligonucleotide
caauuuaugaauauuaucaug

SEQ ID NO: 1744 - RNA, 21 nt, Artificial Sequence
  Description of Artificial Sequence: Synthetic oligonucleotide
  Description of Combined DNA/RNA Molecule: Synthetic oligonucleotide
auuuaugaauauuaucaugcu

SEQ ID NO: 1745 - RNA, 21 nt, Artificial Sequence
  Description of Artificial Sequence: Synthetic oligonucleotide
  Description of Combined DNA/RNA Molecule: Synthetic oligonucleotide
uuaugaauauuaucaugcuuu

SEQ ID NO: 1746 - RNA, 21 nt, Artificial Sequence
  Description of Artificial Sequence: Synthetic oligonucleotide
  Description of Combined DNA/RNA Molecule: Synthetic oligonucleotide
augaauauuaucaugcuuugg

SEQ ID NO: 1747 - RNA, 21 nt, Artificial Sequence
  Description of Artificial Sequence: Synthetic oligonucleotide
  Description of Combined DNA/RNA Molecule: Synthetic oligonucleotide
uauuaucaugcuuuggacucu

SEQ ID NO: 1748 - RNA, 21 nt, Artificial Sequence
  Description of Artificial Sequence: Synthetic oligonucleotide
  Description of Combined DNA/RNA Molecule: Synthetic oligonucleotide
uaucaugcuuuggacucugau

SEQ ID NO: 1749 - RNA, 21 nt, Artificial Sequence
  Description of Artificial Sequence: Synthetic oligonucleotide
  Description of Combined DNA/RNA Molecule: Synthetic oligonucleotide
caugcuuuggacucugaucau

SEQ ID NO: 1750 - RNA, 21 nt, Artificial Sequence
  Description of Artificial Sequence: Synthetic oligonucleotide
  Description of Combined DNA/RNA Molecule: Synthetic oligonucleotide
gcuuuggacucugaucaucug

SEQ ID NO: 1751 - RNA, 21 nt, Artificial Sequence
  Description of Artificial Sequence: Synthetic oligonucleotide
  Description of Combined DNA/RNA Molecule: Synthetic oligonucleotide
acucugaucaucugaccaaaa

SEQ ID NO: 1752 - RNA, 21 nt, Artificial Sequence
  Description of Artificial Sequence: Synthetic oligonucleotide
  Description of Combined DNA/RNA Molecule: Synthetic oligonucleotide
ucugaucaucugaccaaaacu

SEQ ID NO: 1753 - RNA, 21 nt, Artificial Sequence
  Description of Artificial Sequence: Synthetic oligonucleotide
  Description of Combined DNA/RNA Molecule: Synthetic oligonucleotide
ugaucaucugaccaaaacuca

SEQ ID NO: 1754 - RNA, 21 nt, Artificial Sequence
  Description of Artificial Sequence: Synthetic oligonucleotide
  Description of Combined DNA/RNA Molecule: Synthetic oligonucleotide
ucaugauauguuuacuaaagg

SEQ ID NO: 1755 - RNA, 21 nt, Artificial Sequence
  Description of Artificial Sequence: Synthetic oligonucleotide
  Description of Combined DNA/RNA Molecule: Synthetic oligonucleotide
augauauguuuacuaaaggac

SEQ ID NO: 1756 - RNA, 21 nt, Artificial Sequence
  Description of Artificial Sequence: Synthetic oligonucleotide
  Description of Combined DNA/RNA Molecule: Synthetic oligonucleotide
gauauguuuacuaaaggacaa

SEQ ID NO: 1757 - RNA, 21 nt, Artificial Sequence
  Description of Artificial Sequence: Synthetic oligonucleotide
  Description of Combined DNA/RNA Molecule: Synthetic oligonucleotide
uauguuuacuaaaggacaagu

SEQ ID NO: 1758 - RNA, 21 nt, Artificial Sequence
  Description of Artificial Sequence: Synthetic oligonucleotide
  Description of Combined DNA/RNA Molecule: Synthetic oligonucleotide
uguuuacuaaaggacaaguca

SEQ ID NO: 1759 - RNA, 21 nt, Artificial Sequence
  Description of Artificial Sequence: Synthetic oligonucleotide
  Description of Combined DNA/RNA Molecule: Synthetic oligonucleotide
uuuacuaaaggacaagucacc

SEQ ID NO: 1760 - RNA, 21 nt, Artificial Sequence
  Description of Artificial Sequence: Synthetic oligonucleotide
  Description of Combined DNA/RNA Molecule: Synthetic oligonucleotide
uacuaaaggacaagucaccac

SEQ ID NO: 1761 - RNA, 21 nt, Artificial Sequence
  Description of Artificial Sequence: Synthetic oligonucleotide
  Description of Combined DNA/RNA Molecule: Synthetic oligonucleotide
cuaaaggacaagucaccacag

SEQ ID NO: 1762 - RNA, 21 nt, Artificial Sequence
  Description of Artificial Sequence: Synthetic oligonucleotide
  Description of Combined DNA/RNA Molecule: Synthetic oligonucleotide
aaaggacaagucaccacagga

SEQ ID NO: 1763 - RNA, 21 nt, Artificial Sequence
  Description of Artificial Sequence: Synthetic oligonucleotide
  Description of Combined DNA/RNA Molecule: Synthetic oligonucleotide
aggacaagucaccacaggaca

SEQ ID NO: 1764 - RNA, 21 nt, Artificial Sequence
  Description of Artificial Sequence: Synthetic oligonucleotide
  Description of Combined DNA/RNA Molecule: Synthetic oligonucleotide
gacaagucaccacaggacagu

SEQ ID NO: 1765 - RNA, 21 nt, Artificial Sequence
  Description of Artificial Sequence: Synthetic oligonucleotide
  Description of Combined DNA/RNA Molecule: Synthetic oligonucleotide
caagucaccacaggacaguac

SEQ ID NO: 1766 - RNA, 21 nt, Artificial Sequence
  Description of Artificial Sequence: Synthetic oligonucleotide
  Description of Combined DNA/RNA Molecule: Synthetic oligonucleotide
agucaccacaggacaguacag

SEQ ID NO: 1767 - RNA, 21 nt, Artificial Sequence
  Description of Artificial Sequence: Synthetic oligonucleotide
  Description of Combined DNA/RNA Molecule: Synthetic oligonucleotide
ucaccacaggacaguacagga

SEQ ID NO: 1768 - RNA, 21 nt, Artificial Sequence
  Description of Artificial Sequence: Synthetic oligonucleotide
  Description of Combined DNA/RNA Molecule: Synthetic oligonucleotide
accacaggacaguacaggaug

SEQ ID NO: 1769 - RNA, 21 nt, Artificial Sequence
  Description of Artificial Sequence: Synthetic oligonucleotide
  Description of Combined DNA/RNA Molecule: Synthetic oligonucleotide
cacaggacaguacaggaugcu

SEQ ID NO: 1770 - RNA, 21 nt, Artificial Sequence
  Description of Artificial Sequence: Synthetic oligonucleotide
  Description of Combined DNA/RNA Molecule: Synthetic oligonucleotide
caggacaguacaggaugcuug

SEQ ID NO: 1771 - RNA, 21 nt, Artificial Sequence
  Description of Artificial Sequence: Synthetic oligonucleotide
  Description of Combined DNA/RNA Molecule: Synthetic oligonucleotide
ggacaguacaggaugcuugcc

SEQ ID NO: 1772 - RNA, 21 nt, Artificial Sequence
  Description of Artificial Sequence: Synthetic oligonucleotide
  Description of Combined DNA/RNA Molecule: Synthetic oligonucleotide
acaguacaggaugcuugccaa

SEQ ID NO: 1773 - RNA, 21 nt, Artificial Sequence
  Description of Artificial Sequence: Synthetic oligonucleotide
  Description of Combined DNA/RNA Molecule: Synthetic oligonucleotide
aguacaggaugcuugccaaaa

SEQ ID NO: 1774 - RNA, 21 nt, Artificial Sequence
  Description of Artificial Sequence: Synthetic oligonucleotide
  Description of Combined DNA/RNA Molecule: Synthetic oligonucleotide
uacaggaugcuugccaaaaga

SEQ ID NO: 1775 - RNA, 21 nt, Artificial Sequence
  Description of Artificial Sequence: Synthetic oligonucleotide
  Description of Combined DNA/RNA Molecule: Synthetic oligonucleotide
caggaugcuugccaaaagagg

SEQ ID NO: 1776 - RNA, 21 nt, Artificial Sequence
  Description of Artificial Sequence: Synthetic oligonucleotide
  Description of Combined DNA/RNA Molecule: Synthetic oligonucleotide
ggaugcuugccaaaagaggug

SEQ ID NO: 1777 - RNA, 21 nt, Artificial Sequence
  Description of Artificial Sequence: Synthetic oligonucleotide
  Description of Combined DNA/RNA Molecule: Synthetic oligonucleotide
augcuugccaaaagaggugga

SEQ ID NO: 1778 - RNA, 21 nt, Artificial Sequence
  Description of Artificial Sequence: Synthetic oligonucleotide
  Description of Combined DNA/RNA Molecule: Synthetic oligonucleotide
gcuugccaaaagagguggaua

SEQ ID NO: 1779 - RNA, 21 nt, Artificial Sequence
  Description of Artificial Sequence: Synthetic oligonucleotide
  Description of Combined DNA/RNA Molecule: Synthetic oligonucleotide
uugccaaaagagguggauaug

SEQ ID NO: 1780 - RNA, 21 nt, Artificial Sequence
  Description of Artificial Sequence: Synthetic oligonucleotide
  Description of Combined DNA/RNA Molecule: Synthetic oligonucleotide
gccaaaagagguggauauguc

SEQ ID NO: 1781 - RNA, 21 nt, Artificial Sequence
  Description of Artificial Sequence: Synthetic oligonucleotide
  Description of Combined DNA/RNA Molecule: Synthetic oligonucleotide
caaaagagguggauaugucug

SEQ ID NO: 1782 - RNA, 21 nt, Artificial Sequence
  Description of Artificial Sequence: Synthetic oligonucleotide
  Description of Combined DNA/RNA Molecule: Synthetic oligonucleotide
aaagagguggauaugucuggg

SEQ ID NO: 1783 - RNA, 21 nt, Artificial Sequence
  Description of Artificial Sequence: Synthetic oligonucleotide
  Description of Combined DNA/RNA Molecule: Synthetic oligonucleotide
agagguggauaugucuggguu

SEQ ID NO: 1784 - RNA, 21 nt, Artificial Sequence
  Description of Artificial Sequence: Synthetic oligonucleotide
  Description of Combined DNA/RNA Molecule: Synthetic oligonucleotide
agguggauaugucuggguuga

SEQ ID NO: 1785 - RNA, 21 nt, Artificial Sequence
  Description of Artificial Sequence: Synthetic oligonucleotide
  Description of Combined DNA/RNA Molecule: Synthetic oligonucleotide
guggauaugucuggguugaaa

SEQ ID NO: 1786 - RNA, 21 nt, Artificial Sequence
  Description of Artificial Sequence: Synthetic oligonucleotide
  Description of Combined DNA/RNA Molecule: Synthetic oligonucleotide
ggauaugucuggguugaaacu

SEQ ID NO: 1787 - RNA, 21 nt, Artificial Sequence
  Description of Artificial Sequence: Synthetic oligonucleotide
  Description of Combined DNA/RNA Molecule: Synthetic oligonucleotide
auaugucuggguugaaacuca

SEQ ID NO: 1788 - RNA, 21 nt, Artificial Sequence
  Description of Artificial Sequence: Synthetic oligonucleotide
  Description of Combined DNA/RNA Molecule: Synthetic oligonucleotide
augucuggguugaaacucaag

SEQ ID NO: 1789 - RNA, 21 nt, Artificial Sequence
  Description of Artificial Sequence: Synthetic oligonucleotide
  Description of Combined DNA/RNA Molecule: Synthetic oligonucleotide
gucuggguugaaacucaagca

SEQ ID NO: 1790 - RNA, 21 nt, Artificial Sequence
  Description of Artificial Sequence: Synthetic oligonucleotide
  Description of Combined DNA/RNA Molecule: Synthetic oligonucleotide
cuggguugaaacucaagcaac

SEQ ID NO: 1791 - RNA, 21 nt, Artificial Sequence
  Description of Artificial Sequence: Synthetic oligonucleotide
  Description of Combined DNA/RNA Molecule: Synthetic oligonucleotide
ggguugaaacucaagcaacug

SEQ ID NO: 1792 - RNA, 21 nt, Artificial Sequence
  Description of Artificial Sequence: Synthetic oligonucleotide
  Description of Combined DNA/RNA Molecule: Synthetic oligonucleotide
guugaaacucaagcaacuguc

SEQ ID NO: 1793 - RNA, 21 nt, Artificial Sequence
  Description of Artificial Sequence: Synthetic oligonucleotide
  Description of Combined DNA/RNA Molecule: Synthetic oligonucleotide
ugaaacucaagcaacugucau

SEQ ID NO: 1794 - RNA, 21 nt, Artificial Sequence
  Description of Artificial Sequence: Synthetic oligonucleotide
  Description of Combined DNA/RNA Molecule: Synthetic oligonucleotide
aaacucaagcaacugucauau

SEQ ID NO: 1795 - RNA, 21 nt, Artificial Sequence
  Description of Artificial Sequence: Synthetic oligonucleotide
  Description of Combined DNA/RNA Molecule: Synthetic oligonucleotide
acucaagcaacugucauauau

SEQ ID NO: 1796 - RNA, 21 nt, Artificial Sequence
  Description of Artificial Sequence: Synthetic oligonucleotide
  Description of Combined DNA/RNA Molecule: Synthetic oligonucleotide
ucaagcaacugucauauauaa

SEQ ID NO: 1797 - RNA, 21 nt, Artificial Sequence
  Description of Artificial Sequence: Synthetic oligonucleotide
  Description of Combined DNA/RNA Molecule: Synthetic oligonucleotide
gagugguauuauucagcacga

SEQ ID NO: 1798 - RNA, 21 nt, Artificial Sequence
  Description of Artificial Sequence: Synthetic oligonucleotide
  Description of Combined DNA/RNA Molecule: Synthetic oligonucleotide
gugguauuauucagcacgacu

SEQ ID NO: 1799 - RNA, 21 nt, Artificial Sequence
  Description of Artificial Sequence: Synthetic oligonucleotide
  Description of Combined DNA/RNA Molecule: Synthetic oligonucleotide
gguauuauucagcacgacuug

SEQ ID NO: 1800 - RNA, 21 nt, Artificial Sequence
  Description of Artificial Sequence: Synthetic oligonucleotide
  Description of Combined DNA/RNA Molecule: Synthetic oligonucleotide
uauuauucagcacgacuugau

SEQ ID NO: 1801 - RNA, 21 nt, Artificial Sequence
  Description of Artificial Sequence: Synthetic oligonucleotide
  Description of Combined DNA/RNA Molecule: Synthetic oligonucleotide
uuauucagcacgacuugauuu

SEQ ID NO: 1802 - RNA, 21 nt, Artificial Sequence
  Description of Artificial Sequence: Synthetic oligonucleotide
  Description of Combined DNA/RNA Molecule: Synthetic oligonucleotide
auucagcacgacuugauuuuc

SEQ ID NO: 1803 - RNA, 21 nt, Artificial Sequence
  Description of Artificial Sequence: Synthetic oligonucleotide
  Description of Combined DNA/RNA Molecule: Synthetic oligonucleotide
ucagcacgacuugauuuucuc

SEQ ID NO: 1804 - RNA, 21 nt, Artificial Sequence
  Description of Artificial Sequence: Synthetic oligonucleotide
  Description of Combined DNA/RNA Molecule: Synthetic oligonucleotide
agcacgacuugauuuucuccc

SEQ ID NO: 1805 - RNA, 21 nt, Artificial Sequence
  Description of Artificial Sequence: Synthetic oligonucleotide
  Description of Combined DNA/RNA Molecule: Synthetic oligonucleotide
cacgacuugauuuucucccuu

SEQ ID NO: 1806 - RNA, 21 nt, Artificial Sequence
  Description of Artificial Sequence: Synthetic oligonucleotide
  Description of Combined DNA/RNA Molecule: Synthetic oligonucleotide
cgacuugauuuucucccuuca

SEQ ID NO: 1807 - RNA, 21 nt, Artificial Sequence
  Description of Artificial Sequence: Synthetic oligonucleotide
  Description of Combined DNA/RNA Molecule: Synthetic oligonucleotide
acuugauuuucucccuucaac

SEQ ID NO: 1808 - RNA, 21 nt, Artificial Sequence
  Description of Artificial Sequence: Synthetic oligonucleotide
  Description of Combined DNA/RNA Molecule: Synthetic oligonucleotide
uugauuuucucccuucaacaa

SEQ ID NO: 1809 - RNA, 21 nt, Artificial Sequence
  Description of Artificial Sequence: Synthetic oligonucleotide
  Description of Combined DNA/RNA Molecule: Synthetic oligonucleotide
gauuuucucccuucaacaaac

SEQ ID NO: 1810 - RNA, 21 nt, Artificial Sequence
  Description of Artificial Sequence: Synthetic oligonucleotide
  Description of Combined DNA/RNA Molecule: Synthetic oligonucleotide
uuuucucccuucaacaaacag

SEQ ID NO: 1811 - RNA, 21 nt, Artificial Sequence
  Description of Artificial Sequence: Synthetic oligonucleotide
  Description of Combined DNA/RNA Molecule: Synthetic oligonucleotide
gguugaaucuucagauaugaa

SEQ ID NO: 1812 - RNA, 21 nt, Artificial Sequence
  Description of Artificial Sequence: Synthetic oligonucleotide
  Description of Combined DNA/RNA Molecule: Synthetic oligonucleotide
auucaccaaaguugaaucaga

SEQ ID NO: 1813 - RNA, 21 nt, Artificial Sequence
  Description of Artificial Sequence: Synthetic oligonucleotide
  Description of Combined DNA/RNA Molecule: Synthetic oligonucleotide
aagauacaaguagccucuuug

SEQ ID NO: 1814 - RNA, 21 nt, Artificial Sequence
  Description of Artificial Sequence: Synthetic oligonucleotide
  Description of Combined DNA/RNA Molecule: Synthetic oligonucleotide
cacaaucauaucuuuagauuu

SEQ ID NO: 1815 - RNA, 21 nt, Artificial Sequence
  Description of Artificial Sequence: Synthetic oligonucleotide
  Description of Combined DNA/RNA Molecule: Synthetic oligonucleotide
gaaguaccauuauauaaugau

SEQ ID NO: 1816 - RNA, 21 nt, Artificial Sequence
  Description of Artificial Sequence: Synthetic oligonucleotide
  Description of Combined DNA/RNA Molecule: Synthetic oligonucleotide
accauuauauaaugauguaau

SEQ ID NO: 1817 - RNA, 21 nt, Artificial Sequence
  Description of Artificial Sequence: Synthetic oligonucleotide
  Description of Combined DNA/RNA Molecule: Synthetic oligonucleotide
auuacccaccgcugaaacgcc

SEQ ID NO: 1818 - RNA, 21 nt, Artificial Sequence
  Description of Artificial Sequence: Synthetic oligonucleotide
  Description of Combined DNA/RNA Molecule: Synthetic oligonucleotide
gccaaagccacuucgaaguag

SEQ ID NO: 1819 - RNA, 21 nt, Artificial Sequence
  Description of Artificial Sequence: Synthetic oligonucleotide
  Description of Combined DNA/RNA Molecule: Synthetic oligonucleotide
caaagccacuucgaaguagug

SEQ ID NO: 1820 - RNA, 21 nt, Artificial Sequence
  Description of Artificial Sequence: Synthetic oligonucleotide
  Description of Combined DNA/RNA Molecule: Synthetic oligonucleotide
aagccacuucgaaguagugcu

SEQ ID NO: 1821 - RNA, 21 nt, Artificial Sequence
  Description of Artificial Sequence: Synthetic oligonucleotide
  Description of Combined DNA/RNA Molecule: Synthetic oligonucleotide
gccacuucgaaguagugcuga

SEQ ID NO: 1822 - RNA, 21 nt, Artificial Sequence
  Description of Artificial Sequence: Synthetic oligonucleotide
  Description of Combined DNA/RNA Molecule: Synthetic oligonucleotide
cuucgaaguagugcugacccu

SEQ ID NO: 1823 - RNA, 21 nt, Artificial Sequence
  Description of Artificial Sequence: Synthetic oligonucleotide
  Description of Combined DNA/RNA Molecule: Synthetic oligonucleotide
aagaaguugcauuaaaauuag

SEQ ID NO: 1824 - RNA, 21 nt, Artificial Sequence
  Description of Artificial Sequence: Synthetic oligonucleotide
  Description of Combined DNA/RNA Molecule: Synthetic oligonucleotide
cgauggaagcacuagacaaag

SEQ ID NO: 1825 - RNA, 21 nt, Artificial Sequence
  Description of Artificial Sequence: Synthetic oligonucleotide
  Description of Combined DNA/RNA Molecule: Synthetic oligonucleotide
auggaagcacuagacaaaguu

SEQ ID NO: 1826 - RNA, 21 nt, Artificial Sequence
  Description of Artificial Sequence: Synthetic oligonucleotide
  Description of Combined DNA/RNA Molecule: Synthetic oligonucleotide
ggaagcacuagacaaaguuca

SEQ ID NO: 1827 - RNA, 21 nt, Artificial Sequence
  Description of Artificial Sequence: Synthetic oligonucleotide
  Description of Combined DNA/RNA Molecule: Synthetic oligonucleotide
aagcacuagacaaaguucacc

SEQ ID NO: 1828 - RNA, 21 nt, Artificial Sequence
  Description of Artificial Sequence: Synthetic oligonucleotide
  Description of Combined DNA/RNA Molecule: Synthetic oligonucleotide
gcacuagacaaaguucaccug

SEQ ID NO: 1829 - RNA, 21 nt, Artificial Sequence
  Description of Artificial Sequence: Synthetic oligonucleotide
  Description of Combined DNA/RNA Molecule: Synthetic oligonucleotide
acuagacaaaguucaccugag

SEQ ID NO: 1830 - RNA, 21 nt, Artificial Sequence
  Description of Artificial Sequence: Synthetic oligonucleotide
  Description of Combined DNA/RNA Molecule: Synthetic oligonucleotide
ccagugaauauuguuuuuaug

SEQ ID NO: 1831 - RNA, 21 nt, Artificial Sequence
  Description of Artificial Sequence: Synthetic oligonucleotide
  Description of Combined DNA/RNA Molecule: Synthetic oligonucleotide
uauuguuuuuauguggauagu

SEQ ID NO: 1832 - RNA, 21 nt, Artificial Sequence
  Description of Artificial Sequence: Synthetic oligonucleotide
  Description of Combined DNA/RNA Molecule: Synthetic oligonucleotide
ugguagaaaaacuuuuugcug

SEQ ID NO: 1833 - RNA, 21 nt, Artificial Sequence
  Description of Artificial Sequence: Synthetic oligonucleotide
  Description of Combined DNA/RNA Molecule: Synthetic oligonucleotide
agcucccuauaucccaaugga

SEQ ID NO: 1834 - RNA, 21 nt, Artificial Sequence
  Description of Artificial Sequence: Synthetic oligonucleotide
  Description of Combined DNA/RNA Molecule: Synthetic oligonucleotide
cucccuauaucccaauggaug

SEQ ID NO: 1835 - RNA, 21 nt, Artificial Sequence
  Description of Artificial Sequence: Synthetic oligonucleotide
  Description of Combined DNA/RNA Molecule: Synthetic oligonucleotide
cccuauaucccaauggaugau

SEQ ID NO: 1836 - RNA, 21 nt, Artificial Sequence
  Description of Artificial Sequence: Synthetic oligonucleotide
  Description of Combined DNA/RNA Molecule: Synthetic oligonucleotide
cuauaucccaauggaugauga

SEQ ID NO: 1837 - RNA, 21 nt, Artificial Sequence
  Description of Artificial Sequence: Synthetic oligonucleotide
  Description of Combined DNA/RNA Molecule: Synthetic oligonucleotide
cgaucaguugucaccauuaga

SEQ ID NO: 1838 - RNA, 21 nt, Artificial Sequence
  Description of Artificial Sequence: Synthetic oligonucleotide
  Description of Combined DNA/RNA Molecule: Synthetic oligonucleotide
caguuccgcaagcccugaaag

SEQ ID NO: 1839 - RNA, 21 nt, Artificial Sequence
  Description of Artificial Sequence: Synthetic oligonucleotide
  Description of Combined DNA/RNA Molecule: Synthetic oligonucleotide
guuccgcaagcccugaaagcg

SEQ ID NO: 1840 - RNA, 21 nt, Artificial Sequence
  Description of Artificial Sequence: Synthetic oligonucleotide
  Description of Combined DNA/RNA Molecule: Synthetic oligonucleotide
cacugaugaauuaaaaacagu

SEQ ID NO: 1841 - RNA, 21 nt, Artificial Sequence
  Description of Artificial Sequence: Synthetic oligonucleotide
  Description of Combined DNA/RNA Molecule: Synthetic oligonucleotide
ggaagacauuaaaauauugau

SEQ ID NO: 1842 - RNA, 21 nt, Artificial Sequence
  Description of Artificial Sequence: Synthetic oligonucleotide
  Description of Combined DNA/RNA Molecule: Synthetic oligonucleotide
aggagucauagaacagacaga

SEQ ID NO: 1843 - RNA, 21 nt, Artificial Sequence
  Description of Artificial Sequence: Synthetic oligonucleotide
  Description of Combined DNA/RNA Molecule: Synthetic oligonucleotide
aagauacuagcuuugcagaau

SEQ ID NO: 1844 - RNA, 21 nt, Artificial Sequence
  Description of Artificial Sequence: Synthetic oligonucleotide
  Description of Combined DNA/RNA Molecule: Synthetic oligonucleotide
cucagagaaagcgaaaaaugg

SEQ ID NO: 1845 - RNA, 21 nt, Artificial Sequence
  Description of Artificial Sequence: Synthetic oligonucleotide
  Description of Combined DNA/RNA Molecule: Synthetic oligonucleotide
aaagcgaaaaauggaacauga

SEQ ID NO: 1846 - RNA, 21 nt, Artificial Sequence
  Description of Artificial Sequence: Synthetic oligonucleotide
  Description of Combined DNA/RNA Molecule: Synthetic oligonucleotide
agcgaaaaauggaacaugaug

SEQ ID NO: 1847 - RNA, 21 nt, Artificial Sequence
  Description of Artificial Sequence: Synthetic oligonucleotide
  Description of Combined DNA/RNA Molecule: Synthetic oligonucleotide
caagcaguaggaauuggaaca

SEQ ID NO: 1848 - RNA, 21 nt, Artificial Sequence
  Description of Artificial Sequence: Synthetic oligonucleotide
  Description of Combined DNA/RNA Molecule: Synthetic oligonucleotide
aaaucuagugaacagaaugga

SEQ ID NO: 1849 - RNA, 21 nt, Artificial Sequence
  Description of Artificial Sequence: Synthetic oligonucleotide
  Description of Combined DNA/RNA Molecule: Synthetic oligonucleotide
agcaaaagacaauuauuuuaa

SEQ ID NO: 1850 - RNA, 21 nt, Artificial Sequence
  Description of Artificial Sequence: Synthetic oligonucleotide
  Description of Combined DNA/RNA Molecule: Synthetic oligonucleotide
aaaguggauuaccacagcuga

SEQ ID NO: 1851 - RNA, 21 nt, Artificial Sequence
  Description of Artificial Sequence: Synthetic oligonucleotide
  Description of Combined DNA/RNA Molecule: Synthetic oligonucleotide
aguggauuaccacagcugacc

SEQ ID NO: 1852 - RNA, 21 nt, Artificial Sequence
  Description of Artificial Sequence: Synthetic oligonucleotide
  Description of Combined DNA/RNA Molecule: Synthetic oligonucleotide
uggauuaccacagcugaccag

SEQ ID NO: 1853 - RNA, 21 nt, Artificial Sequence
  Description of Artificial Sequence: Synthetic oligonucleotide
  Description of Combined DNA/RNA Molecule: Synthetic oligonucleotide
gauuaccacagcugaccaguu

SEQ ID NO: 1854 - RNA, 21 nt, Artificial Sequence
  Description of Artificial Sequence: Synthetic oligonucleotide
  Description of Combined DNA/RNA Molecule: Synthetic oligonucleotide
augauugugaaguuaaugcuc

SEQ ID NO: 1855 - RNA, 21 nt, Artificial Sequence
  Description of Artificial Sequence: Synthetic oligonucleotide
  Description of Combined DNA/RNA Molecule: Synthetic oligonucleotide
cuauacaaggcagcagaaacc

SEQ ID NO: 1856 - RNA, 21 nt, Artificial Sequence
  Description of Artificial Sequence: Synthetic oligonucleotide
  Description of Combined DNA/RNA Molecule: Synthetic oligonucleotide
auacaaggcagcagaaaccua

SEQ ID NO: 1857 - RNA, 21 nt, Artificial Sequence
  Description of Artificial Sequence: Synthetic oligonucleotide
  Description of Combined DNA/RNA Molecule: Synthetic oligonucleotide
acaaggcagcagaaaccuacu

SEQ ID NO: 1858 - RNA, 21 nt, Artificial Sequence
  Description of Artificial Sequence: Synthetic oligonucleotide
  Description of Combined DNA/RNA Molecule: Synthetic oligonucleotide
aaggcagcagaaaccuacugc

SEQ ID NO: 1859 - RNA, 21 nt, Artificial Sequence
  Description of Artificial Sequence: Synthetic oligonucleotide
  Description of Combined DNA/RNA Molecule: Synthetic oligonucleotide
ggcagcagaaaccuacugcag

SEQ ID NO: 1860 - RNA, 21 nt, Artificial Sequence
  Description of Artificial Sequence: Synthetic oligonucleotide
  Description of Combined DNA/RNA Molecule: Synthetic oligonucleotide
cagcagaaaccuacugcaggg

SEQ ID NO: 1861 - RNA, 21 nt, Artificial Sequence
  Description of Artificial Sequence: Synthetic oligonucleotide
  Description of Combined DNA/RNA Molecule: Synthetic oligonucleotide
gcagaaaccuacugcagggug

SEQ ID NO: 1862 - RNA, 21 nt, Artificial Sequence
  Description of Artificial Sequence: Synthetic oligonucleotide
  Description of Combined DNA/RNA Molecule: Synthetic oligonucleotide
agaaaccuacugcagggugaa

SEQ ID NO: 1863 - RNA, 21 nt, Artificial Sequence
  Description of Artificial Sequence: Synthetic oligonucleotide
  Description of Combined DNA/RNA Molecule: Synthetic oligonucleotide
aaaccuacugcagggugaaga

SEQ ID NO: 1864 - RNA, 21 nt, Artificial Sequence
  Description of Artificial Sequence: Synthetic oligonucleotide
  Description of Combined DNA/RNA Molecule: Synthetic oligonucleotide
accuacugcagggugaagaau

SEQ ID NO: 1865 - RNA, 21 nt, Artificial Sequence
  Description of Artificial Sequence: Synthetic oligonucleotide
  Description of Combined DNA/RNA Molecule: Synthetic oligonucleotide
cuacugcagggugaagaauua

SEQ ID NO: 1866 - RNA, 21 nt, Artificial Sequence
  Description of Artificial Sequence: Synthetic oligonucleotide
  Description of Combined DNA/RNA Molecule: Synthetic oligonucleotide
acugcagggugaagaauuacu

SEQ ID NO: 1867 - RNA, 21 nt, Artificial Sequence
  Description of Artificial Sequence: Synthetic oligonucleotide
  Description of Combined DNA/RNA Molecule: Synthetic oligonucleotide
ugcagggugaagaauuacuca

SEQ ID NO: 1868 - RNA, 21 nt, Artificial Sequence
  Description of Artificial Sequence: Synthetic oligonucleotide
  Description of Combined DNA/RNA Molecule: Synthetic oligonucleotide
cagggugaagaauuacucaga

SEQ ID NO: 1869 - RNA, 21 nt, Artificial Sequence
  Description of Artificial Sequence: Synthetic oligonucleotide
  Description of Combined DNA/RNA Molecule: Synthetic oligonucleotide
gggugaagaauuacucagagc

SEQ ID NO: 1870 - RNA, 21 nt, Artificial Sequence
  Description of Artificial Sequence: Synthetic oligonucleotide
  Description of Combined DNA/RNA Molecule: Synthetic oligonucleotide
gugaagaauuacucagagcuu

SEQ ID NO: 1871 - RNA, 21 nt, Artificial Sequence
  Description of Artificial Sequence: Synthetic oligonucleotide
  Description of Combined DNA/RNA Molecule: Synthetic oligonucleotide
gaagaauuacucagagcuuug

SEQ ID NO: 1872 - RNA, 21 nt, Artificial Sequence
  Description of Artificial Sequence: Synthetic oligonucleotide
  Description of Combined DNA/RNA Molecule: Synthetic oligonucleotide
agaauuacucagagcuuugga

SEQ ID NO: 1873 - RNA, 21 nt, Artificial Sequence
  Description of Artificial Sequence: Synthetic oligonucleotide
  Description of Combined DNA/RNA Molecule: Synthetic oligonucleotide
aauuacucagagcuuuggauc

SEQ ID NO: 1874 - RNA, 21 nt, Artificial Sequence
  Description of Artificial Sequence: Synthetic oligonucleotide
  Description of Combined DNA/RNA Molecule: Synthetic oligonucleotide
uuacucagagcuuuggaucaa

SEQ ID NO: 1875 - RNA, 21 nt, Artificial Sequence
  Description of Artificial Sequence: Synthetic oligonucleotide
  Description of Combined DNA/RNA Molecule: Synthetic oligonucleotide
acucagagcuuuggaucaagu

SEQ ID NO: 1876 - RNA, 21 nt, Artificial Sequence
  Description of Artificial Sequence: Synthetic oligonucleotide
  Description of Combined DNA/RNA Molecule: Synthetic oligonucleotide
ucagagcuuuggaucaaguua

SEQ ID NO: 1877 - RNA, 21 nt, Artificial Sequence
  Description of Artificial Sequence: Synthetic oligonucleotide
  Description of Combined DNA/RNA Molecule: Synthetic oligonucleotide
agagcuuuggaucaaguuaac

SEQ ID NO: 1878 - RNA, 21 nt, Artificial Sequence
  Description of Artificial Sequence: Synthetic oligonucleotide
  Description of Combined DNA/RNA Molecule: Synthetic oligonucleotide
agcuuuggaucaaguuaacug

SEQ ID NO: 1879 - RNA, 21 nt, Artificial Sequence
  Description of Artificial Sequence: Synthetic oligonucleotide
  Description of Combined DNA/RNA Molecule: Synthetic oligonucleotide
cuuuggaucaaguuaacugag

SEQ ID NO: 1880 - RNA, 21 nt, Artificial Sequence
  Description of Artificial Sequence: Synthetic oligonucleotide
  Description of Combined DNA/RNA Molecule: Synthetic oligonucleotide
uggaucaaguuaacugagcuu

SEQ ID NO: 1881 - RNA, 21 nt, Artificial Sequence
  Description of Artificial Sequence: Synthetic oligonucleotide
  Description of Combined DNA/RNA Molecule: Synthetic oligonucleotide
aacugagcuuuuucuuaauuu

SEQ ID NO: 1882 - RNA, 21 nt, Artificial Sequence
  Description of Artificial Sequence: Synthetic oligonucleotide
  Description of Combined DNA/RNA Molecule: Synthetic oligonucleotide
gagcuuuuucuuaauuucauu

SEQ ID NO: 1883 - RNA, 21 nt, Artificial Sequence
  Description of Artificial Sequence: Synthetic oligonucleotide
  Description of Combined DNA/RNA Molecule: Synthetic oligonucleotide
cuuaauuucauuccuuuuuuu

SEQ ID NO: 1884 - RNA, 21 nt, Artificial Sequence
  Description of Artificial Sequence: Synthetic oligonucleotide
  Description of Combined DNA/RNA Molecule: Synthetic oligonucleotide
uucauuccuuuuuuuggacac

SEQ ID NO: 1885 - RNA, 21 nt, Artificial Sequence
  Description of Artificial Sequence: Synthetic oligonucleotide
  Description of Combined DNA/RNA Molecule: Synthetic oligonucleotide
uuuuuuuggacacugguggcu

SEQ ID NO: 1886 - RNA, 21 nt, Artificial Sequence
  Description of Artificial Sequence: Synthetic oligonucleotide
  Description of Combined DNA/RNA Molecule: Synthetic oligonucleotide
uuuuuggacacugguggcuca

SEQ ID NO: 1887 - RNA, 21 nt, Artificial Sequence
  Description of Artificial Sequence: Synthetic oligonucleotide
  Description of Combined DNA/RNA Molecule: Synthetic oligonucleotide
aagcagucuauuuauauuuuc

SEQ ID NO: 1888 - RNA, 21 nt, Artificial Sequence
  Description of Artificial Sequence: Synthetic oligonucleotide
  Description of Combined DNA/RNA Molecule: Synthetic oligonucleotide
gcagucuauuuauauuuucua

SEQ ID NO: 1889 - RNA, 21 nt, Artificial Sequence
  Description of Artificial Sequence: Synthetic oligonucleotide
  Description of Combined DNA/RNA Molecule: Synthetic oligonucleotide
cuauuuauauuuucuacaucu

SEQ ID NO: 1890 - RNA, 21 nt, Artificial Sequence
  Description of Artificial Sequence: Synthetic oligonucleotide
  Description of Combined DNA/RNA Molecule: Synthetic oligonucleotide
caucuaauuuuagaagccugg

SEQ ID NO: 1891 - RNA, 21 nt, Artificial Sequence
  Description of Artificial Sequence: Synthetic oligonucleotide
  Description of Combined DNA/RNA Molecule: Synthetic oligonucleotide
ucuaauuuuagaagccuggcu

SEQ ID NO: 1892 - RNA, 21 nt, Artificial Sequence
  Description of Artificial Sequence: Synthetic oligonucleotide
  Description of Combined DNA/RNA Molecule: Synthetic oligonucleotide
uaauuuuagaagccuggcuac

SEQ ID NO: 1893 - RNA, 21 nt, Artificial Sequence
  Description of Artificial Sequence: Synthetic oligonucleotide
  Description of Combined DNA/RNA Molecule: Synthetic oligonucleotide
auuuuagaagccuggcuacaa

SEQ ID NO: 1894 - RNA, 21 nt, Artificial Sequence
  Description of Artificial Sequence: Synthetic oligonucleotide
  Description of Combined DNA/RNA Molecule: Synthetic oligonucleotide
uuuagaagccuggcuacaaua

SEQ ID NO: 1895 - RNA, 21 nt, Artificial Sequence
  Description of Artificial Sequence: Synthetic oligonucleotide
  Description of Combined DNA/RNA Molecule: Synthetic oligonucleotide
uagaagccuggcuacaauacu

SEQ ID NO: 1896 - RNA, 21 nt, Artificial Sequence
  Description of Artificial Sequence: Synthetic oligonucleotide
  Description of Combined DNA/RNA Molecule: Synthetic oligonucleotide
gaagccuggcuacaauacugc

SEQ ID NO: 1897 - RNA, 21 nt, Artificial Sequence
  Description of Artificial Sequence: Synthetic oligonucleotide
  Description of Combined DNA/RNA Molecule: Synthetic oligonucleotide
agccuggcuacaauacugcac

SEQ ID NO: 1898 - RNA, 21 nt, Artificial Sequence
  Description of Artificial Sequence: Synthetic oligonucleotide
  Description of Combined DNA/RNA Molecule: Synthetic oligonucleotide
ccuggcuacaauacugcacaa

SEQ ID NO: 1899 - RNA, 21 nt, Artificial Sequence
  Description of Artificial Sequence: Synthetic oligonucleotide
  Description of Combined DNA/RNA Molecule: Synthetic oligonucleotide
uggcuacaauacugcacaaac

SEQ ID NO: 1900 - RNA, 21 nt, Artificial Sequence
  Description of Artificial Sequence: Synthetic oligonucleotide
  Description of Combined DNA/RNA Molecule: Synthetic oligonucleotide
cuuaauuuacauuaaugcucu

SEQ ID NO: 1901 - RNA, 21 nt, Artificial Sequence
  Description of Artificial Sequence: Synthetic oligonucleotide
  Description of Combined DNA/RNA Molecule: Synthetic oligonucleotide
auuaaugcucuuuuuuaguau

SEQ ID NO: 1902 - RNA, 21 nt, Artificial Sequence
  Description of Artificial Sequence: Synthetic oligonucleotide
  Description of Combined DNA/RNA Molecule: Synthetic oligonucleotide
uaaugcucuuuuuuaguaugu

SEQ ID NO: 1903 - RNA, 21 nt, Artificial Sequence
  Description of Artificial Sequence: Synthetic oligonucleotide
  Description of Combined DNA/RNA Molecule: Synthetic oligonucleotide
aaugcucuuuuuuaguauguu

SEQ ID NO: 1904 - RNA, 21 nt, Artificial Sequence
  Description of Artificial Sequence: Synthetic oligonucleotide
  Description of Combined DNA/RNA Molecule: Synthetic oligonucleotide
uuuuaguauguucuuuaaugc

SEQ ID NO: 1905 - RNA, 21 nt, Artificial Sequence
  Description of Artificial Sequence: Synthetic oligonucleotide
  Description of Combined DNA/RNA Molecule: Synthetic oligonucleotide
aguauguucuuuaaugcugga

SEQ ID NO: 1906 - RNA, 21 nt, Artificial Sequence
  Description of Artificial Sequence: Synthetic oligonucleotide
  Description of Combined DNA/RNA Molecule: Synthetic oligonucleotide
ucuuuaaugcuggaucacaga

SEQ ID NO: 1907 - RNA, 21 nt, Artificial Sequence
  Description of Artificial Sequence: Synthetic oligonucleotide
  Description of Combined DNA/RNA Molecule: Synthetic oligonucleotide
aaugcuggaucacagacagcu

SEQ ID NO: 1908 - RNA, 21 nt, Artificial Sequence
  Description of Artificial Sequence: Synthetic oligonucleotide
  Description of Combined DNA/RNA Molecule: Synthetic oligonucleotide
agcucauuuucucaguuuuuu

SEQ ID NO: 1909 - RNA, 21 nt, Artificial Sequence
  Description of Artificial Sequence: Synthetic oligonucleotide
  Description of Combined DNA/RNA Molecule: Synthetic oligonucleotide
aaaaaaugcaccuuuuuauuu

SEQ ID NO: 1910 - RNA, 21 nt, Artificial Sequence
  Description of Artificial Sequence: Synthetic oligonucleotide
  Description of Combined DNA/RNA Molecule: Synthetic oligonucleotide
aaaaugcaccuuuuuauuuau

SEQ ID NO: 1911 - RNA, 21 nt, Artificial Sequence
  Description of Artificial Sequence: Synthetic oligonucleotide
  Description of Combined DNA/RNA Molecule: Synthetic oligonucleotide
aaugcaccuuuuuauuuauuu

SEQ ID NO: 1912 - RNA, 21 nt, Artificial Sequence
  Description of Artificial Sequence: Synthetic oligonucleotide
  Description of Combined DNA/RNA Molecule: Synthetic oligonucleotide
ugcaccuuuuuauuuauuuau

SEQ ID NO: 1913 - RNA, 21 nt, Artificial Sequence
  Description of Artificial Sequence: Synthetic oligonucleotide
  Description of Combined DNA/RNA Molecule: Synthetic oligonucleotide
caccuuuuuauuuauuuauuu

SEQ ID NO: 1914 - RNA, 21 nt, Artificial Sequence
  Description of Artificial Sequence: Synthetic oligonucleotide
  Description of Combined DNA/RNA Molecule: Synthetic oligonucleotide
ccuuuuuauuuauuuauuuuu

SEQ ID NO: 1915 - RNA, 21 nt, Artificial Sequence
  Description of Artificial Sequence: Synthetic oligonucleotide
  Description of Combined DNA/RNA Molecule: Synthetic oligonucleotide
uuuuuauuuauuuauuuuugg

SEQ ID NO: 1916 - RNA, 21 nt, Artificial Sequence
  Description of Artificial Sequence: Synthetic oligonucleotide
  Description of Combined DNA/RNA Molecule: Synthetic oligonucleotide
cuuuuucgaauuauuuuuaag

SEQ ID NO: 1917 - RNA, 21 nt, Artificial Sequence
  Description of Artificial Sequence: Synthetic oligonucleotide
  Description of Combined DNA/RNA Molecule: Synthetic oligonucleotide
gccaauauaauuuuuguaaga

SEQ ID NO: 1918 - RNA, 21 nt, Artificial Sequence
  Description of Artificial Sequence: Synthetic oligonucleotide
  Description of Combined DNA/RNA Molecule: Synthetic oligonucleotide
uucaucaugaucauaggcagu

SEQ ID NO: 1919 - RNA, 21 nt, Artificial Sequence
  Description of Artificial Sequence: Synthetic oligonucleotide
  Description of Combined DNA/RNA Molecule: Synthetic oligonucleotide
caucaugaucauaggcaguug

SEQ ID NO: 1920 - RNA, 21 nt, Artificial Sequence
  Description of Artificial Sequence: Synthetic oligonucleotide
  Description of Combined DNA/RNA Molecule: Synthetic oligonucleotide
ucaugaucauaggcaguugaa

SEQ ID NO: 1921 - RNA, 21 nt, Artificial Sequence
  Description of Artificial Sequence: Synthetic oligonucleotide
  Description of Combined DNA/RNA Molecule: Synthetic oligonucleotide
augaucauaggcaguugaaaa

SEQ ID NO: 1922 - RNA, 21 nt, Artificial Sequence
  Description of Artificial Sequence: Synthetic oligonucleotide
  Description of Combined DNA/RNA Molecule: Synthetic oligonucleotide
aguugaaaaauuuuuacaccu

SEQ ID NO: 1923 - RNA, 21 nt, Artificial Sequence
  Description of Artificial Sequence: Synthetic oligonucleotide
  Description of Combined DNA/RNA Molecule: Synthetic oligonucleotide
ccuuuuuuuucacauuuuaca

SEQ ID NO: 1924 - RNA, 21 nt, Artificial Sequence
  Description of Artificial Sequence: Synthetic oligonucleotide
  Description of Combined DNA/RNA Molecule: Synthetic oligonucleotide
gugguagccacaauugcacaa

SEQ ID NO: 1925 - RNA, 21 nt, Artificial Sequence
  Description of Artificial Sequence: Synthetic oligonucleotide
  Description of Combined DNA/RNA Molecule: Synthetic oligonucleotide
gguagccacaauugcacaaua

SEQ ID NO: 1926 - RNA, 21 nt, Artificial Sequence
  Description of Artificial Sequence: Synthetic oligonucleotide
  Description of Combined DNA/RNA Molecule: Synthetic oligonucleotide
uagccacaauugcacaauaua

SEQ ID NO: 1927 - RNA, 21 nt, Artificial Sequence
  Description of Artificial Sequence: Synthetic oligonucleotide
  Description of Combined DNA/RNA Molecule: Synthetic oligonucleotide
gccacaauugcacaauauauu

SEQ ID NO: 1928 - RNA, 21 nt, Artificial Sequence
  Description of Artificial Sequence: Synthetic oligonucleotide
  Description of Combined DNA/RNA Molecule: Synthetic oligonucleotide
cacaauugcacaauauauuuu

SEQ ID NO: 1929 - RNA, 21 nt, Artificial Sequence
  Description of Artificial Sequence: Synthetic oligonucleotide
  Description of Combined DNA/RNA Molecule: Synthetic oligonucleotide
caauugcacaauauauuuucu

SEQ ID NO: 1930 - RNA, 21 nt, Artificial Sequence
  Description of Artificial Sequence: Synthetic oligonucleotide
  Description of Combined DNA/RNA Molecule: Synthetic oligonucleotide
cacaauauauuuucuuaaaaa

SEQ ID NO: 1931 - RNA, 21 nt, Artificial Sequence
  Description of Artificial Sequence: Synthetic oligonucleotide
  Description of Combined DNA/RNA Molecule: Synthetic oligonucleotide
gcguuuauaaaacuaguuuuu

SEQ ID NO: 1932 - RNA, 21 nt, Artificial Sequence
  Description of Artificial Sequence: Synthetic oligonucleotide
  Description of Combined DNA/RNA Molecule: Synthetic oligonucleotide
cguuuauaaaacuaguuuuua

SEQ ID NO: 1933 - RNA, 21 nt, Artificial Sequence
  Description of Artificial Sequence: Synthetic oligonucleotide
  Description of Combined DNA/RNA Molecule: Synthetic oligonucleotide
uuuauaaaacuaguuuuuaag

SEQ ID NO: 1934 - RNA, 21 nt, Artificial Sequence
  Description of Artificial Sequence: Synthetic oligonucleotide
  Description of Combined DNA/RNA Molecule: Synthetic oligonucleotide
uauaaaacuaguuuuuaagaa

SEQ ID NO: 1935 - RNA, 21 nt, Artificial Sequence
  Description of Artificial Sequence: Synthetic oligonucleotide
  Description of Combined DNA/RNA Molecule: Synthetic oligonucleotide
uuuuaagaagaaauuuuuuuu

SEQ ID NO: 1936 - RNA, 21 nt, Artificial Sequence
  Description of Artificial Sequence: Synthetic oligonucleotide
  Description of Combined DNA/RNA Molecule: Synthetic oligonucleotide
gaagaaauuuuuuuuggccua

SEQ ID NO: 1937 - RNA, 21 nt, Artificial Sequence
  Description of Artificial Sequence: Synthetic oligonucleotide
  Description of Combined DNA/RNA Molecule: Synthetic oligonucleotide
agaaauuuuuuuuggccuaug

SEQ ID NO: 1938 - RNA, 21 nt, Artificial Sequence
  Description of Artificial Sequence: Synthetic oligonucleotide
  Description of Combined DNA/RNA Molecule: Synthetic oligonucleotide
ccuaugaaauuguuaaaccug

SEQ ID NO: 1939 - RNA, 21 nt, Artificial Sequence
  Description of Artificial Sequence: Synthetic oligonucleotide
  Description of Combined DNA/RNA Molecule: Synthetic oligonucleotide
acauuguuaaucauauaauaa

SEQ ID NO: 1940 - RNA, 21 nt, Artificial Sequence
  Description of Artificial Sequence: Synthetic oligonucleotide
  Description of Combined DNA/RNA Molecule: Synthetic oligonucleotide
guaugguuuauuauuuaaaug

SEQ ID NO: 1941 - RNA, 21 nt, Artificial Sequence
  Description of Artificial Sequence: Synthetic oligonucleotide
  Description of Combined DNA/RNA Molecule: Synthetic oligonucleotide
aauggguaaagccauuuacau

SEQ ID NO: 1942 - RNA, 21 nt, Artificial Sequence
  Description of Artificial Sequence: Synthetic oligonucleotide
  Description of Combined DNA/RNA Molecule: Synthetic oligonucleotide
ccauuuacauaauauagaaag

SEQ ID NO: 1943 - RNA, 21 nt, Artificial Sequence
  Description of Artificial Sequence: Synthetic oligonucleotide
  Description of Combined DNA/RNA Molecule: Synthetic oligonucleotide
agaagguauguggcauuuauu

SEQ ID NO: 1944 - RNA, 21 nt, Artificial Sequence
  Description of Artificial Sequence: Synthetic oligonucleotide
  Description of Combined DNA/RNA Molecule: Synthetic oligonucleotide
aagguauguggcauuuauuug

SEQ ID NO: 1945 - RNA, 21 nt, Artificial Sequence
  Description of Artificial Sequence: Synthetic oligonucleotide
  Description of Combined DNA/RNA Molecule: Synthetic oligonucleotide
gguauguggcauuuauuugga

SEQ ID NO: 1946 - RNA, 21 nt, Artificial Sequence
  Description of Artificial Sequence: Synthetic oligonucleotide
  Description of Combined DNA/RNA Molecule: Synthetic oligonucleotide
uauguggcauuuauuuggaua

SEQ ID NO: 1947 - RNA, 21 nt, Artificial Sequence
  Description of Artificial Sequence: Synthetic oligonucleotide
  Description of Combined DNA/RNA Molecule: Synthetic oligonucleotide
uguggcauuuauuuggauaaa

SEQ ID NO: 1948 - RNA, 21 nt, Artificial Sequence
  Description of Artificial Sequence: Synthetic oligonucleotide
  Description of Combined DNA/RNA Molecule: Synthetic oligonucleotide
uggcauuuauuuggauaaaau

SEQ ID NO: 1949 - RNA, 21 nt, Artificial Sequence
  Description of Artificial Sequence: Synthetic oligonucleotide
  Description of Combined DNA/RNA Molecule: Synthetic oligonucleotide
gcauuuauuuggauaaaauuc

SEQ ID NO: 1950 - RNA, 21 nt, Artificial Sequence
  Description of Artificial Sequence: Synthetic oligonucleotide
  Description of Combined DNA/RNA Molecule: Synthetic oligonucleotide
auuuauuuggauaaaauucuc

SEQ ID NO: 1951 - RNA, 21 nt, Artificial Sequence
  Description of Artificial Sequence: Synthetic oligonucleotide
  Description of Combined DNA/RNA Molecule: Synthetic oligonucleotide
uuauuuggauaaaauucucaa

SEQ ID NO: 1952 - RNA, 21 nt, Artificial Sequence
  Description of Artificial Sequence: Synthetic oligonucleotide
  Description of Combined DNA/RNA Molecule: Synthetic oligonucleotide
uuauuuggauaaaauucucaa

SEQ ID NO: 1953 - RNA, 21 nt, Artificial Sequence
  Description of Artificial Sequence: Synthetic oligonucleotide
  Description of Combined DNA/RNA Molecule: Synthetic oligonucleotide
auuuggauaaaauucucaauu

SEQ ID NO: 1954 - RNA, 21 nt, Artificial Sequence
  Description of Artificial Sequence: Synthetic oligonucleotide
  Description of Combined DNA/RNA Molecule: Synthetic oligonucleotide
uuggauaaaauucucaauuca

SEQ ID NO: 1955 - RNA, 21 nt, Artificial Sequence
  Description of Artificial Sequence: Synthetic oligonucleotide
  Description of Combined DNA/RNA Molecule: Synthetic oligonucleotide
ggauaaaauucucaauucaga

SEQ ID NO: 1956 - RNA, 21 nt, Artificial Sequence
  Description of Artificial Sequence: Synthetic oligonucleotide
  Description of Combined DNA/RNA Molecule: Synthetic oligonucleotide
auaaaauucucaauucagaga

SEQ ID NO: 1957 - RNA, 21 nt, Artificial Sequence
  Description of Artificial Sequence: Synthetic oligonucleotide
  Description of Combined DNA/RNA Molecule: Synthetic oligonucleotide
caucugauguuucuauaguca

SEQ ID NO: 1958 - RNA, 21 nt, Artificial Sequence
  Description of Artificial Sequence: Synthetic oligonucleotide
  Description of Combined DNA/RNA Molecule: Synthetic oligonucleotide
auguuucuauagucacuuugc

SEQ ID NO: 1959 - RNA, 21 nt, Artificial Sequence
  Description of Artificial Sequence: Synthetic oligonucleotide
  Description of Combined DNA/RNA Molecule: Synthetic oligonucleotide
ucuauagucacuuugccagcu

SEQ ID NO: 1960 - RNA, 21 nt, Artificial Sequence
  Description of Artificial Sequence: Synthetic oligonucleotide
  Description of Combined DNA/RNA Molecule: Synthetic oligonucleotide
cucaaaagaaaacaauacccu

SEQ ID NO: 1961 - RNA, 21 nt, Artificial Sequence
  Description of Artificial Sequence: Synthetic oligonucleotide
  Description of Combined DNA/RNA Molecule: Synthetic oligonucleotide
uguucugccuacccuguuggu

SEQ ID NO: 1962 - RNA, 21 nt, Artificial Sequence
  Description of Artificial Sequence: Synthetic oligonucleotide
  Description of Combined DNA/RNA Molecule: Synthetic oligonucleotide
uucugccuacccuguugguau

SEQ ID NO: 1963 - RNA, 21 nt, Artificial Sequence
  Description of Artificial Sequence: Synthetic oligonucleotide
  Description of Combined DNA/RNA Molecule: Synthetic oligonucleotide
ucugccuacccuguugguaua

SEQ ID NO: 1964 - RNA, 21 nt, Artificial Sequence
  Description of Artificial Sequence: Synthetic oligonucleotide
  Description of Combined DNA/RNA Molecule: Synthetic oligonucleotide
ugccuacccuguugguauaaa

SEQ ID NO: 1965 - RNA, 21 nt, Artificial Sequence
  Description of Artificial Sequence: Synthetic oligonucleotide
  Description of Combined DNA/RNA Molecule: Synthetic oligonucleotide
gccuacccuguugguauaaag

SEQ ID NO: 1966 - RNA, 21 nt, Artificial Sequence
  Description of Artificial Sequence: Synthetic oligonucleotide
  Description of Combined DNA/RNA Molecule: Synthetic oligonucleotide
cccuguugguauaaagauauu

SEQ ID NO: 1967 - RNA, 21 nt, Artificial Sequence
  Description of Artificial Sequence: Synthetic oligonucleotide
  Description of Combined DNA/RNA Molecule: Synthetic oligonucleotide
uguugguauaaagauauuuug

SEQ ID NO: 1968 - RNA, 21 nt, Artificial Sequence
  Description of Artificial Sequence: Synthetic oligonucleotide
  Description of Combined DNA/RNA Molecule: Synthetic oligonucleotide
caagaaaaaaaaaaucaugca

SEQ ID NO: 1969 - RNA, 21 nt, Artificial Sequence
  Description of Artificial Sequence: Synthetic oligonucleotide
  Description of Combined DNA/RNA Molecule: Synthetic oligonucleotide
aguauguuaauuugcucaaaa

SEQ ID NO: 1970 - RNA, 21 nt, Artificial Sequence
  Description of Artificial Sequence: Synthetic oligonucleotide
  Description of Combined DNA/RNA Molecule: Synthetic oligonucleotide
gauuuuaugcacuuugucgcu

SEQ ID NO: 1971 - RNA, 21 nt, Artificial Sequence
  Description of Artificial Sequence: Synthetic oligonucleotide
  Description of Combined DNA/RNA Molecule: Synthetic oligonucleotide
uuuuaugcacuuugucgcuau

SEQ ID NO: 1972 - RNA, 21 nt, Artificial Sequence
  Description of Artificial Sequence: Synthetic oligonucleotide
  Description of Combined DNA/RNA Molecule: Synthetic oligonucleotide
uuaugcacuuugucgcuauua

SEQ ID NO: 1973 - RNA, 21 nt, Artificial Sequence
  Description of Artificial Sequence: Synthetic oligonucleotide
  Description of Combined DNA/RNA Molecule: Synthetic oligonucleotide
augcacuuugucgcuauuaac

SEQ ID NO: 1974 - RNA, 21 nt, Artificial Sequence
  Description of Artificial Sequence: Synthetic oligonucleotide
  Description of Combined DNA/RNA Molecule: Synthetic oligonucleotide
gcacuuugucgcuauuaacau

SEQ ID NO: 1975 - RNA, 21 nt, Artificial Sequence
  Description of Artificial Sequence: Synthetic oligonucleotide
  Description of Combined DNA/RNA Molecule: Synthetic oligonucleotide
acuuugucgcuauuaacaucc

SEQ ID NO: 1976 - RNA, 21 nt, Artificial Sequence
  Description of Artificial Sequence: Synthetic oligonucleotide
  Description of Combined DNA/RNA Molecule: Synthetic oligonucleotide
uuugucgcuauuaacauccuu

SEQ ID NO: 1977 - RNA, 21 nt, Artificial Sequence
  Description of Artificial Sequence: Synthetic oligonucleotide
  Description of Combined DNA/RNA Molecule: Synthetic oligonucleotide
ugucgcuauuaacauccuuuu

SEQ ID NO: 1978 - RNA, 21 nt, Artificial Sequence
  Description of Artificial Sequence: Synthetic oligonucleotide
  Description of Combined DNA/RNA Molecule: Synthetic oligonucleotide
ucgcuauuaacauccuuuuuu

SEQ ID NO: 1979 - RNA, 21 nt, Artificial Sequence
  Description of Artificial Sequence: Synthetic oligonucleotide
  Description of Combined DNA/RNA Molecule: Synthetic oligonucleotide
cuauuaacauccuuuuuuuca

SEQ ID NO: 1980 - RNA, 21 nt, Artificial Sequence
  Description of Artificial Sequence: Synthetic oligonucleotide
  Description of Combined DNA/RNA Molecule: Synthetic oligonucleotide
uugaguaauuuuagaagcauu

SEQ ID NO: 1981 - RNA, 21 nt, Artificial Sequence
  Description of Artificial Sequence: Synthetic oligonucleotide
  Description of Combined DNA/RNA Molecule: Synthetic oligonucleotide
gaguaauuuuagaagcauuau

SEQ ID NO: 1982 - RNA, 21 nt, Artificial Sequence
  Description of Artificial Sequence: Synthetic oligonucleotide
  Description of Combined DNA/RNA Molecule: Synthetic oligonucleotide
guaauuuuagaagcauuauuu

SEQ ID NO: 1983 - RNA, 21 nt, Artificial Sequence
  Description of Artificial Sequence: Synthetic oligonucleotide
  Description of Combined DNA/RNA Molecule: Synthetic oligonucleotide
aauuuuagaagcauuauuuua

SEQ ID NO: 1984 - RNA, 21 nt, Artificial Sequence
  Description of Artificial Sequence: Synthetic oligonucleotide
  Description of Combined DNA/RNA Molecule: Synthetic oligonucleotide
uuuuagaagcauuauuuuagg

SEQ ID NO: 1985 - RNA, 21 nt, Artificial Sequence
  Description of Artificial Sequence: Synthetic oligonucleotide
  Description of Combined DNA/RNA Molecule: Synthetic oligonucleotide
uuagaagcauuauuuuaggaa

SEQ ID NO: 1986 - RNA, 21 nt, Artificial Sequence
  Description of Artificial Sequence: Synthetic oligonucleotide
  Description of Combined DNA/RNA Molecule: Synthetic oligonucleotide
agaagcauuauuuuaggaaua

SEQ ID NO: 1987 - RNA, 21 nt, Artificial Sequence
  Description of Artificial Sequence: Synthetic oligonucleotide
  Description of Combined DNA/RNA Molecule: Synthetic oligonucleotide
aagcauuauuuuaggaauaua

SEQ ID NO: 1988 - RNA, 21 nt, Artificial Sequence
  Description of Artificial Sequence: Synthetic oligonucleotide
  Description of Combined DNA/RNA Molecule: Synthetic oligonucleotide
aguaaauaucuuguuuuuucu

SEQ ID NO: 1989 - RNA, 21 nt, Artificial Sequence
  Description of Artificial Sequence: Synthetic oligonucleotide
  Description of Combined DNA/RNA Molecule: Synthetic oligonucleotide
cuauguacauuguacaaauuu

SEQ ID NO: 1990 - RNA, 21 nt, Artificial Sequence
  Description of Artificial Sequence: Synthetic oligonucleotide
  Description of Combined DNA/RNA Molecule: Synthetic oligonucleotide
uuuucauuccuuuugcucuuu

SEQ ID NO: 1991 - RNA, 21 nt, Artificial Sequence
  Description of Artificial Sequence: Synthetic oligonucleotide
  Description of Combined DNA/RNA Molecule: Synthetic oligonucleotide
uuucauuccuuuugcucuuug

SEQ ID NO: 1992 - RNA, 21 nt, Artificial Sequence
  Description of Artificial Sequence: Synthetic oligonucleotide
  Description of Combined DNA/RNA Molecule: Synthetic oligonucleotide
uucauuccuuuugcucuuugu

SEQ ID NO: 1993 - RNA, 21 nt, Artificial Sequence
  Description of Artificial Sequence: Synthetic oligonucleotide
  Description of Combined DNA/RNA Molecule: Synthetic oligonucleotide
cauuccuuuugcucuuugugg

SEQ ID NO: 1994 - RNA, 21 nt, Artificial Sequence
  Description of Artificial Sequence: Synthetic oligonucleotide
  Description of Combined DNA/RNA Molecule: Synthetic oligonucleotide
auuccuuuugcucuuuguggu

SEQ ID NO: 1995 - RNA, 21 nt, Artificial Sequence
  Description of Artificial Sequence: Synthetic oligonucleotide
  Description of Combined DNA/RNA Molecule: Synthetic oligonucleotide
uuccuuuugcucuuugugguu

SEQ ID NO: 1996 - RNA, 21 nt, Artificial Sequence
  Description of Artificial Sequence: Synthetic oligonucleotide
  Description of Combined DNA/RNA Molecule: Synthetic oligonucleotide
uccuuuugcucuuugugguug

SEQ ID NO: 1997 - RNA, 21 nt, Artificial Sequence
  Description of Artificial Sequence: Synthetic oligonucleotide
  Description of Combined DNA/RNA Molecule: Synthetic oligonucleotide
ccuuuugcucuuugugguugg

SEQ ID NO: 1998 - RNA, 21 nt, Artificial Sequence
  Description of Artificial Sequence: Synthetic oligonucleotide
  Description of Combined DNA/RNA Molecule: Synthetic oligonucleotide
cuuuugcucuuugugguugga

SEQ ID NO: 1999 - RNA, 21 nt, Artificial Sequence
  Description of Artificial Sequence: Synthetic oligonucleotide
  Description of Combined DNA/RNA Molecule: Synthetic oligonucleotide
uuuugcucuuugugguuggau

SEQ ID NO: 2000 - RNA, 21 nt, Artificial Sequence
  Description of Artificial Sequence: Synthetic oligonucleotide
  Description of Combined DNA/RNA Molecule: Synthetic oligonucleotide
uuugcucuuugugguuggauc

SEQ ID NO: 2001 - RNA, 21 nt, Artificial Sequence
  Description of Artificial Sequence: Synthetic oligonucleotide
  Description of Combined DNA/RNA Molecule: Synthetic oligonucleotide
ugcucuuugugguuggaucua

SEQ ID NO: 2002 - RNA, 21 nt, Artificial Sequence
  Description of Artificial Sequence: Synthetic oligonucleotide
  Description of Combined DNA/RNA Molecule: Synthetic oligonucleotide
acaucaaauaaacaucuucug

SEQ ID NO: 2003 - RNA, 21 nt, Artificial Sequence
  Description of Artificial Sequence: Synthetic oligonucleotide
  Description of Combined DNA/RNA Molecule: Synthetic oligonucleotide
aucaaauaaacaucuucugug

SEQ ID NO: 2004 - RNA, 21 nt, Artificial Sequence
  Description of Artificial Sequence: Synthetic oligonucleotide
  Description of Combined DNA/RNA Molecule: Synthetic oligonucleotide
caaauaaacaucuucugugga

SEQ ID NO: 2005 - RNA, 21 nt, Artificial Sequence
  Description of Artificial Sequence: Synthetic oligonucleotide
  Description of Combined DNA/RNA Molecule: Synthetic oligonucleotide
aauaaacaucuucuguggacc

SEQ ID NO: 2006 - RNA, 21 nt, Artificial Sequence
  Description of Artificial Sequence: Synthetic oligonucleotide
  Description of Combined DNA/RNA Molecule: Synthetic oligonucleotide
uaaacaucuucuguggaccag

SEQ ID NO: 2007 - RNA, 21 nt, Artificial Sequence
  Description of Artificial Sequence: Synthetic oligonucleotide
  Description of Combined DNA/RNA Molecule: Synthetic oligonucleotide
aacaucuucuguggaccaggc

SEQ ID NO: 2008 - RNA, 21 nt, Artificial Sequence
  Description of Artificial Sequence: Synthetic oligonucleotide
  Description of Combined DNA/RNA Molecule: Synthetic oligonucleotide
gcccgcgggcgcgcgcguugg

SEQ ID NO: 2009 - RNA, 21 nt, Artificial Sequence
  Description of Artificial Sequence: Synthetic oligonucleotide
  Description of Combined DNA/RNA Molecule: Synthetic oligonucleotide
ccgcgggcgcgcgcguugggu

SEQ ID NO: 2010 - RNA, 21 nt, Artificial Sequence
  Description of Artificial Sequence: Synthetic oligonucleotide
  Description of Combined DNA/RNA Molecule: Synthetic oligonucleotide
cgcgggcgcgcgcguugggug

SEQ ID NO: 2011 - RNA, 21 nt, Artificial Sequence
  Description of Artificial Sequence: Synthetic oligonucleotide
  Description of Combined DNA/RNA Molecule: Synthetic oligonucleotide
gcgggcgcgcgcguugggugc

SEQ ID NO: 2012 - RNA, 21 nt, Artificial Sequence
  Description of Artificial Sequence: Synthetic oligonucleotide
  Description of Combined DNA/RNA Molecule: Synthetic oligonucleotide
cgggcgcgcgcguugggugcu

SEQ ID NO: 2013 - RNA, 21 nt, Artificial Sequence
  Description of Artificial Sequence: Synthetic oligonucleotide
  Description of Combined DNA/RNA Molecule: Synthetic oligonucleotide
gggcgcgcgcguugggugcug

SEQ ID NO: 2014 - RNA, 21 nt, Artificial Sequence
  Description of Artificial Sequence: Synthetic oligonucleotide
  Description of Combined DNA/RNA Molecule: Synthetic oligonucleotide
ggcgcgcgcguugggugcuga

SEQ ID NO: 2015 - RNA, 21 nt, Artificial Sequence
  Description of Artificial Sequence: Synthetic oligonucleotide
  Description of Combined DNA/RNA Molecule: Synthetic oligonucleotide
gcgcgcgcguugggugcugag

SEQ ID NO: 2016 - RNA, 21 nt, Artificial Sequence
  Description of Artificial Sequence: Synthetic oligonucleotide
  Description of Combined DNA/RNA Molecule: Synthetic oligonucleotide
cgcgcgcguugggugcugagc

SEQ ID NO: 2017 - RNA, 21 nt, Artificial Sequence
  Description of Artificial Sequence: Synthetic oligonucleotide
  Description of Combined DNA/RNA Molecule: Synthetic oligonucleotide
cgcgcguugggugcugagcgg

SEQ ID NO: 2018 - RNA, 21 nt, Artificial Sequence
  Description of Artificial Sequence: Synthetic oligonucleotide
  Description of Combined DNA/RNA Molecule: Synthetic oligonucleotide
gcgcguugggugcugagcggg

SEQ ID NO: 2019 - RNA, 21 nt, Artificial Sequence
  Description of Artificial Sequence: Synthetic oligonucleotide
  Description of Combined DNA/RNA Molecule: Synthetic oligonucleotide
cgcguugggugcugagcgggc

SEQ ID NO: 2020 - RNA, 21 nt, Artificial Sequence
  Description of Artificial Sequence: Synthetic oligonucleotide
  Description of Combined DNA/RNA Molecule: Synthetic oligonucleotide
gcguugggugcugagcgggcg

SEQ ID NO: 2021 - RNA, 21 nt, Artificial Sequence
  Description of Artificial Sequence: Synthetic oligonucleotide
  Description of Combined DNA/RNA Molecule: Synthetic oligonucleotide
cguugggugcugagcgggcgc

SEQ ID NO: 2022 - RNA, 21 nt, Artificial Sequence
  Description of Artificial Sequence: Synthetic oligonucleotide
  Description of Combined DNA/RNA Molecule: Synthetic oligonucleotide
uugggugcugagcgggcgcgc

SEQ ID NO: 2023 - RNA, 21 nt, Artificial Sequence
  Description of Artificial Sequence: Synthetic oligonucleotide
  Description of Combined DNA/RNA Molecule: Synthetic oligonucleotide
cccucgccgcgcgcccgagcg

SEQ ID NO: 2024 - RNA, 21 nt, Artificial Sequence
  Description of Artificial Sequence: Synthetic oligonucleotide
  Description of Combined DNA/RNA Molecule: Synthetic oligonucleotide
ccucgccgcgcgcccgagcgc

SEQ ID NO: 2025 - RNA, 21 nt, Artificial Sequence
  Description of Artificial Sequence: Synthetic oligonucleotide
  Description of Combined DNA/RNA Molecule: Synthetic oligonucleotide
cucgccgcgcgcccgagcgcg

SEQ ID NO: 2026 - RNA, 21 nt, Artificial Sequence
  Description of Artificial Sequence: Synthetic oligonucleotide
  Description of Combined DNA/RNA Molecule: Synthetic oligonucleotide
ucgccgcgcgcccgagcgcgc

SEQ ID NO: 2027 - RNA, 21 nt, Artificial Sequence
  Description of Artificial Sequence: Synthetic oligonucleotide
  Description of Combined DNA/RNA Molecule: Synthetic oligonucleotide
ccugccgcugcuucagcgccu

SEQ ID NO: 2028 - RNA, 21 nt, Artificial Sequence
  Description of Artificial Sequence: Synthetic oligonucleotide
  Description of Combined DNA/RNA Molecule: Synthetic oligonucleotide
ugccgcugcuucagcgccuca

SEQ ID NO: 2029 - RNA, 21 nt, Artificial Sequence
  Description of Artificial Sequence: Synthetic oligonucleotide
  Description of Combined DNA/RNA Molecule: Synthetic oligonucleotide
gcugcuucagcgccucagugc

SEQ ID NO: 2030 - RNA, 21 nt, Artificial Sequence
  Description of Artificial Sequence: Synthetic oligonucleotide
  Description of Combined DNA/RNA Molecule: Synthetic oligonucleotide
cugcuucagcgccucagugca

SEQ ID NO: 2031 - RNA, 21 nt, Artificial Sequence
  Description of Artificial Sequence: Synthetic oligonucleotide
  Description of Combined DNA/RNA Molecule: Synthetic oligonucleotide
gcuucagcgccucagugcaca

SEQ ID NO: 2032 - RNA, 21 nt, Artificial Sequence
  Description of Artificial Sequence: Synthetic oligonucleotide
  Description of Combined DNA/RNA Molecule: Synthetic oligonucleotide
cagcgccucagugcacagagc

SEQ ID NO: 2033 - RNA, 21 nt, Artificial Sequence
  Description of Artificial Sequence: Synthetic oligonucleotide
  Description of Combined DNA/RNA Molecule: Synthetic oligonucleotide
gagccggagcucagcgagcgc

SEQ ID NO: 2034 - RNA, 21 nt, Artificial Sequence
  Description of Artificial Sequence: Synthetic oligonucleotide
  Description of Combined DNA/RNA Molecule: Synthetic oligonucleotide
gagcucagcgagcgcagccug

SEQ ID NO: 2035 - RNA, 21 nt, Artificial Sequence
  Description of Artificial Sequence: Synthetic oligonucleotide
  Description of Combined DNA/RNA Molecule: Synthetic oligonucleotide
cagcgagcgcagccugcagcu

SEQ ID NO: 2036 - RNA, 21 nt, Artificial Sequence
  Description of Artificial Sequence: Synthetic oligonucleotide
  Description of Combined DNA/RNA Molecule: Synthetic oligonucleotide
agcgagcgcagccugcagcuc

SEQ ID NO: 2037 - RNA, 21 nt, Artificial Sequence
  Description of Artificial Sequence: Synthetic oligonucleotide
  Description of Combined DNA/RNA Molecule: Synthetic oligonucleotide
gcgagcgcagccugcagcucc

SEQ ID NO: 2038 - RNA, 21 nt, Artificial Sequence
  Description of Artificial Sequence: Synthetic oligonucleotide
  Description of Combined DNA/RNA Molecule: Synthetic oligonucleotide
gagcgcagccugcagcucccg

SEQ ID NO: 2039 - RNA, 21 nt, Artificial Sequence
  Description of Artificial Sequence: Synthetic oligonucleotide
  Description of Combined DNA/RNA Molecule: Synthetic oligonucleotide
cgcagccugcagcucccgccu

SEQ ID NO: 2040 - RNA, 21 nt, Artificial Sequence
  Description of Artificial Sequence: Synthetic oligonucleotide
  Description of Combined DNA/RNA Molecule: Synthetic oligonucleotide
uggacuugucucuuucuccgc

SEQ ID NO: 2041 - RNA, 21 nt, Artificial Sequence
  Description of Artificial Sequence: Synthetic oligonucleotide
  Description of Combined DNA/RNA Molecule: Synthetic oligonucleotide
gacuugucucuuucuccgcgc

SEQ ID NO: 2042 - RNA, 21 nt, Artificial Sequence
  Description of Artificial Sequence: Synthetic oligonucleotide
  Description of Combined DNA/RNA Molecule: Synthetic oligonucleotide
cuugucucuuucuccgcgcgc

SEQ ID NO: 2043 - RNA, 21 nt, Artificial Sequence
  Description of Artificial Sequence: Synthetic oligonucleotide
  Description of Combined DNA/RNA Molecule: Synthetic oligonucleotide
uugucucuuucuccgcgcgcg

SEQ ID NO: 2044 - RNA, 21 nt, Artificial Sequence
  Description of Artificial Sequence: Synthetic oligonucleotide
  Description of Combined DNA/RNA Molecule: Synthetic oligonucleotide
ugucucuuucuccgcgcgcgc

SEQ ID NO: 2045 - RNA, 21 nt, Artificial Sequence
  Description of Artificial Sequence: Synthetic oligonucleotide
  Description of Combined DNA/RNA Molecule: Synthetic oligonucleotide
cucuuucuccgcgcgcgcgga

SEQ ID NO: 2046 - RNA, 21 nt, Artificial Sequence
  Description of Artificial Sequence: Synthetic oligonucleotide
  Description of Combined DNA/RNA Molecule: Synthetic oligonucleotide
cuuucuccgcgcgcgcggaca

SEQ ID NO: 2047 - RNA, 21 nt, Artificial Sequence
  Description of Artificial Sequence: Synthetic oligonucleotide
  Description of Combined DNA/RNA Molecule: Synthetic oligonucleotide
ccgcgcgcgcggacagagccg

SEQ ID NO: 2048 - RNA, 21 nt, Artificial Sequence
  Description of Artificial Sequence: Synthetic oligonucleotide
  Description of Combined DNA/RNA Molecule: Synthetic oligonucleotide
gugagcucacaucuugauaaa

SEQ ID NO: 2049 - RNA, 21 nt, Artificial Sequence
  Description of Artificial Sequence: Synthetic oligonucleotide
  Description of Combined DNA/RNA Molecule: Synthetic oligonucleotide
agcucacaucuugauaaagcu

SEQ ID NO: 2050 - RNA, 21 nt, Artificial Sequence
  Description of Artificial Sequence: Synthetic oligonucleotide
  Description of Combined DNA/RNA Molecule: Synthetic oligonucleotide
uggacuguuuuuaucugaaag

SEQ ID NO: 2051 - RNA, 21 nt, Artificial Sequence
  Description of Artificial Sequence: Synthetic oligonucleotide
  Description of Combined DNA/RNA Molecule: Synthetic oligonucleotide
cacccaugacgugcuuggugc

SEQ ID NO: 2052 - RNA, 21 nt, Artificial Sequence
  Description of Artificial Sequence: Synthetic oligonucleotide
  Description of Combined DNA/RNA Molecule: Synthetic oligonucleotide
gauacaagcugccuuuuugau

SEQ ID NO: 2053 - RNA, 21 nt, Artificial Sequence
  Description of Artificial Sequence: Synthetic oligonucleotide
  Description of Combined DNA/RNA Molecule: Synthetic oligonucleotide
uacaagcugccuuuuugauaa

SEQ ID NO: 2054 - RNA, 21 nt, Artificial Sequence
  Description of Artificial Sequence: Synthetic oligonucleotide
  Description of Combined DNA/RNA Molecule: Synthetic oligonucleotide
acaagcugccuuuuugauaag

SEQ ID NO: 2055 - RNA, 21 nt, Artificial Sequence
  Description of Artificial Sequence: Synthetic oligonucleotide
  Description of Combined DNA/RNA Molecule: Synthetic oligonucleotide
agcugccuuuuugauaagcuu

SEQ ID NO: 2056 - RNA, 21 nt, Artificial Sequence
  Description of Artificial Sequence: Synthetic oligonucleotide
  Description of Combined DNA/RNA Molecule: Synthetic oligonucleotide
gaugcucucacucugcuggcu

SEQ ID NO: 2057 - RNA, 21 nt, Artificial Sequence
  Description of Artificial Sequence: Synthetic oligonucleotide
  Description of Combined DNA/RNA Molecule: Synthetic oligonucleotide
augcucucacucugcuggcuc

SEQ ID NO: 2058 - RNA, 21 nt, Artificial Sequence
  Description of Artificial Sequence: Synthetic oligonucleotide
  Description of Combined DNA/RNA Molecule: Synthetic oligonucleotide
ugcucucacucugcuggcucc

SEQ ID NO: 2059 - RNA, 21 nt, Artificial Sequence
  Description of Artificial Sequence: Synthetic oligonucleotide
  Description of Combined DNA/RNA Molecule: Synthetic oligonucleotide
cucugcuggcuccagcugccg

SEQ ID NO: 2060 - RNA, 21 nt, Artificial Sequence
  Description of Artificial Sequence: Synthetic oligonucleotide
  Description of Combined DNA/RNA Molecule: Synthetic oligonucleotide
cuucgaaguagugcugauccu

SEQ ID NO: 2061 - RNA, 21 nt, Artificial Sequence
  Description of Artificial Sequence: Synthetic oligonucleotide
  Description of Combined DNA/RNA Molecule: Synthetic oligonucleotide
aauauugcuuugauguggaua

SEQ ID NO: 2062 - RNA, 21 nt, Artificial Sequence
  Description of Artificial Sequence: Synthetic oligonucleotide
  Description of Combined DNA/RNA Molecule: Synthetic oligonucleotide
uauugcuuugauguggauagc

SEQ ID NO: 2063 - RNA, 21 nt, Artificial Sequence
  Description of Artificial Sequence: Synthetic oligonucleotide
  Description of Combined DNA/RNA Molecule: Synthetic oligonucleotide
uugcuuugauguggauagcga

SEQ ID NO: 2064 - RNA, 21 nt, Artificial Sequence
  Description of Artificial Sequence: Synthetic oligonucleotide
  Description of Combined DNA/RNA Molecule: Synthetic oligonucleotide
augauggcucccuuuuucaag

SEQ ID NO: 2065 - RNA, 21 nt, Artificial Sequence
  Description of Artificial Sequence: Synthetic oligonucleotide
  Description of Combined DNA/RNA Molecule: Synthetic oligonucleotide
guuucuguugguuauuuuugg

SEQ ID NO: 2066 - RNA, 21 nt, Artificial Sequence
  Description of Artificial Sequence: Synthetic oligonucleotide
  Description of Combined DNA/RNA Molecule: Synthetic oligonucleotide
uguuaagccuggaucaugaag

SEQ ID NO: 2067 - RNA, 21 nt, Artificial Sequence
  Description of Artificial Sequence: Synthetic oligonucleotide
  Description of Combined DNA/RNA Molecule: Synthetic oligonucleotide
agccuggaucaugaagcuguu

SEQ ID NO: 2068 - RNA, 21 nt, Artificial Sequence
  Description of Artificial Sequence: Synthetic oligonucleotide
  Description of Combined DNA/RNA Molecule: Synthetic oligonucleotide
agcuguugaucuuauaaugau

SEQ ID NO: 2069 - RNA, 21 nt, Artificial Sequence
  Description of Artificial Sequence: Synthetic oligonucleotide
  Description of Combined DNA/RNA Molecule: Synthetic oligonucleotide
augauucuuaaacuguauggu

SEQ ID NO: 2070 - RNA, 21 nt, Artificial Sequence
  Description of Artificial Sequence: Synthetic oligonucleotide
  Description of Combined DNA/RNA Molecule: Synthetic oligonucleotide
cuguaugguuucuuuauaugg

SEQ ID NO: 2071 - RNA, 21 nt, Artificial Sequence
  Description of Artificial Sequence: Synthetic oligonucleotide
  Description of Combined DNA/RNA Molecule: Synthetic oligonucleotide
cauaguaaacaucuuguuuuu

SEQ ID NO: 2072 - RNA, 21 nt, Artificial Sequence
  Description of Artificial Sequence: Synthetic oligonucleotide
  Description of Combined DNA/RNA Molecule: Synthetic oligonucleotide
uuuucguucccuugcucuuug

SEQ ID NO: 2073 - RNA, 21 nt, Artificial Sequence
  Description of Artificial Sequence: Synthetic oligonucleotide
  Description of Combined DNA/RNA Molecule: Synthetic oligonucleotide
uuucguucccuugcucuuugu

SEQ ID NO: 2074 - RNA, 21 nt, Artificial Sequence
  Description of Artificial Sequence: Synthetic oligonucleotide
  Description of Combined DNA/RNA Molecule: Synthetic oligonucleotide
uucccuugcucuuugugguug

SEQ ID NO: 2075 - RNA, 21 nt, Artificial Sequence
  Description of Artificial Sequence: Synthetic oligonucleotide
  Description of Combined DNA/RNA Molecule: Synthetic oligonucleotide
uuuccgcgcucucagggagcu

SEQ ID NO: 2076 - RNA, 21 nt, Artificial Sequence
  Description of Artificial Sequence: Synthetic oligonucleotide
  Description of Combined DNA/RNA Molecule: Synthetic oligonucleotide
accugauguuucuuuacuuug

SEQ ID NO: 2077 - RNA, 21 nt, Artificial Sequence
  Description of Artificial Sequence: Synthetic oligonucleotide
  Description of Combined DNA/RNA Molecule: Synthetic oligonucleotide
ccugauguuucuuuacuuugc

SEQ ID NO: 2078 - RNA, 21 nt, Artificial Sequence
  Description of Artificial Sequence: Synthetic oligonucleotide
  Description of Combined DNA/RNA Molecule: Synthetic oligonucleotide
cugauguuucuuuacuuugcc

SEQ ID NO: 2079 - RNA, 21 nt, Artificial Sequence
  Description of Artificial Sequence: Synthetic oligonucleotide
  Description of Combined DNA/RNA Molecule: Synthetic oligonucleotide
uugccagcuuuaaaaaaguau

SEQ ID NO: 2080 - DNA, 25 bp, Artificial Sequence
  Description of Artificial Sequence: Synthetic oligonucleotide
  Description of Combined DNA/RNA Molecule: Synthetic oligonucleotide
ucaagcaacugucauauauaaaacc

SEQ ID NO: 2081 - DNA, 25 bp, Artificial Sequence
  Description of Artificial Sequence: Synthetic oligonucleotide
  Description of Combined DNA/RNA Molecule: Synthetic oligonucleotide
ucaagcaacugucauauauaacccc

SEQ ID NO: 2082 - DNA, 25 bp, Artificial Sequence
  Description of Artificial Sequence: Synthetic oligonucleotide
  Description of Combined DNA/RNA Molecule: Synthetic oligonucleotide
ucaagcaacugucauauauaacaac

SEQ ID NO: 2083 - DNA, 25 bp, Artificial Sequence
  Description of Artificial Sequence: Synthetic oligonucleotide
  Description of Combined DNA/RNA Molecule: Synthetic oligonucleotide
ucaagcaacugucauauauaacaca

SEQ ID NO: 2084 - RNA, 27 nt, Artificial Sequence
  Description of Artificial Sequence: Synthetic oligonucleotide
  Description of Combined DNA/RNA Molecule: Synthetic oligonucleotide
aguguuauauaugacaguugcuugagu

SEQ ID NO: 2085 - RNA, 27 nt, Artificial Sequence
  Description of Artificial Sequence: Synthetic oligonucleotide
  Description of Combined DNA/RNA Molecule: Synthetic oligonucleotide
gauguuauauaugacaguugcuugagu

SEQ ID NO: 2086 - RNA, 27 nt, Artificial Sequence
  Description of Artificial Sequence: Synthetic oligonucleotide
  Description of Combined DNA/RNA Molecule: Synthetic oligonucleotide
ggcguuauauaugacaguugcuugagu

SEQ ID NO: 2087 - RNA, 27 nt, Artificial Sequence
  Description of Artificial Sequence: Synthetic oligonucleotide
  Description of Combined DNA/RNA Molecule: Synthetic oligonucleotide
gguauuauauaugacaguugcuugagu

SEQ ID NO: 2088 - RNA, 25 nt, Artificial Sequence
  Description of Artificial Sequence: Synthetic oligonucleotide
  Description of Combined DNA/RNA Molecule: Synthetic oligonucleotide
  misc_feature (22)..(25): n is a, c, g, or u
ucaagcaacugucauauauaannnn

SEQ ID NO: 2089 - RNA, 27 nt, Artificial Sequence
  Description of Artificial Sequence: Synthetic oligonucleotide
  Description of Combined DNA/RNA Molecule: Synthetic oligonucleotide
  misc_feature (1)..(6): n is a, c, g, or u
nnnnnnauauaugacaguugcuugagu

SEQ ID NO: 2090 - DNA, 27 bp, Artificial Sequence
  Description of Artificial Sequence: Synthetic oligonucleotide
  Description of Combined DNA/RNA Molecule: Synthetic oligonucleotide
  misc_feature (22)..(27): n is a, c, g, or t
actcaagcaactgtcatatatnnnnnn

SEQ ID NO: 2091 - DNA, 39 bp, Artificial Sequence
  Description of Artificial Sequence: Synthetic oligonucleotide
  Description of Combined DNA/RNA Molecule: Synthetic oligonucleotide
ggcagcagaaacctactgcagggtgaagaattactcaga

SEQ ID NO: 2092 - RNA, 21 nt, Artificial Sequence
  Description of Artificial Sequence: Synthetic oligonucleotide
  Description of Combined DNA/RNA Molecule: Synthetic oligonucleotide
auauaugacaguugcuugagu

SEQ ID NO: 2093 - RNA, 21 nt, Artificial Sequence
  Description of Artificial Sequence: Synthetic oligonucleotide
  Description of Combined DNA/RNA Molecule: Synthetic oligonucleotide
ucaagcaacugucauauauaa

SEQ ID NO: 2094 - RNA, 21 nt, Artificial Sequence
  Description of Artificial Sequence: Synthetic oligonucleotide
  Description of Combined DNA/RNA Molecule: Synthetic oligonucleotide
acucaagcaacugucauauau

SEQ ID NO: 2095 - RNA, 21 nt, Artificial Sequence
  Description of Artificial Sequence: Synthetic oligonucleotide
  Description of Combined DNA/RNA Molecule: Synthetic oligonucleotide
acucaagcaacugucauaucc

SEQ ID NO: 2096 - RNA, 27 nt, Artificial Sequence
  Description of Artificial Sequence: Synthetic oligonucleotide
  Description of Combined DNA/RNA Molecule: Synthetic oligonucleotide
ucuuuucgacguucagaacuuaucuuu

SEQ ID NO: 2097 - RNA, 27 nt, Artificial Sequence
  Description of Artificial Sequence: Synthetic oligonucleotide
  Description of Combined DNA/RNA Molecule: Synthetic oligonucleotide
uuuucuuuucgacguucagaacuuauc

SEQ ID NO: 2098 - RNA, 27 nt, Artificial Sequence
  Description of Artificial Sequence: Synthetic oligonucleotide
  Description of Combined DNA/RNA Molecule: Synthetic oligonucleotide
acuuuucuuuucgacguucagaacuua

SEQ ID NO: 2099 - RNA, 27 nt, Artificial Sequence
  Description of Artificial Sequence: Synthetic oligonucleotide
  Description of Combined DNA/RNA Molecule: Synthetic oligonucleotide
cgagacuuuucuuuucgacguucagaa

SEQ ID NO: 2100 - RNA, 27 nt, Artificial Sequence
  Description of Artificial Sequence: Synthetic oligonucleotide
  Description of Combined DNA/RNA Molecule: Synthetic oligonucleotide
cugcaucucgagacuuuucuuuucgac

SEQ ID NO: 2101 - RNA, 27 nt, Artificial Sequence
  Description of Artificial Sequence: Synthetic oligonucleotide
  Description of Combined DNA/RNA Molecule: Synthetic oligonucleotide
gcugcaucucgagacuuuucuuuucga

SEQ ID NO: 2102 - RNA, 27 nt, Artificial Sequence
  Description of Artificial Sequence: Synthetic oligonucleotide
  Description of Combined DNA/RNA Molecule: Synthetic oligonucleotide
aaaaaacuucagauucuuuacuucgcc

SEQ ID NO: 2103 - RNA, 27 nt, Artificial Sequence
  Description of Artificial Sequence: Synthetic oligonucleotide
  Description of Combined DNA/RNA Molecule: Synthetic oligonucleotide
uaaaaaacuucagauucuuuacuucgc

SEQ ID NO: 2104 - RNA, 27 nt, Artificial Sequence
  Description of Artificial Sequence: Synthetic oligonucleotide
  Description of Combined DNA/RNA Molecule: Synthetic oligonucleotide
cauaaaaaacuucagauucuuuacuuc

SEQ ID NO: 2105 - RNA, 27 nt, Artificial Sequence
  Description of Artificial Sequence: Synthetic oligonucleotide
  Description of Combined DNA/RNA Molecule: Synthetic oligonucleotide
ucauaaaaaacuucagauucuuuacuu

SEQ ID NO: 2106 - RNA, 27 nt, Artificial Sequence
  Description of Artificial Sequence: Synthetic oligonucleotide
  Description of Combined DNA/RNA Molecule: Synthetic oligonucleotide
gcucauaaaaaacuucagauucuuuac

SEQ ID NO: 2107 - RNA, 27 nt, Artificial Sequence
  Description of Artificial Sequence: Synthetic oligonucleotide
  Description of Combined DNA/RNA Molecule: Synthetic oligonucleotide
ugagcaagcucauaaaaaacuucagau

SEQ ID NO: 2108 - RNA, 27 nt, Artificial Sequence
  Description of Artificial Sequence: Synthetic oligonucleotide
  Description of Combined DNA/RNA Molecule: Synthetic oligonucleotide
acucacauuauguggaaguggcaacug

SEQ ID NO: 2109 - RNA, 27 nt, Artificial Sequence
  Description of Artificial Sequence: Synthetic oligonucleotide
  Description of Combined DNA/RNA Molecule: Synthetic oligonucleotide
aggccuuaucaagaugcgaacucacau

SEQ ID NO: 2110 - RNA, 27 nt, Artificial Sequence
  Description of Artificial Sequence: Synthetic oligonucleotide
  Description of Combined DNA/RNA Molecule: Synthetic oligonucleotide
acgcaaauagcugaugguaagccucau

SEQ ID NO: 2111 - RNA, 27 nt, Artificial Sequence
  Description of Artificial Sequence: Synthetic oligonucleotide
  Description of Combined DNA/RNA Molecule: Synthetic oligonucleotide
aaucaccagcauccagaaguuuccuca

SEQ ID NO: 2112 - RNA, 27 nt, Artificial Sequence
  Description of Artificial Sequence: Synthetic oligonucleotide
  Description of Combined DNA/RNA Molecule: Synthetic oligonucleotide
ucaucuucaauauccaaaucaccagca

SEQ ID NO: 2113 - RNA, 27 nt, Artificial Sequence
  Description of Artificial Sequence: Synthetic oligonucleotide
  Description of Combined DNA/RNA Molecule: Synthetic oligonucleotide
ugucaucuucaauauccaaaucaccag

SEQ ID NO: 2114 - RNA, 27 nt, Artificial Sequence
  Description of Artificial Sequence: Synthetic oligonucleotide
  Description of Combined DNA/RNA Molecule: Synthetic oligonucleotide
cuuucaugucaucuucaauauccaaau

SEQ ID NO: 2115 - RNA, 27 nt, Artificial Sequence
  Description of Artificial Sequence: Synthetic oligonucleotide
  Description of Combined DNA/RNA Molecule: Synthetic oligonucleotide
gcuuucaugucaucuucaauauccaaa

SEQ ID NO: 2116 - RNA, 27 nt, Artificial Sequence
  Description of Artificial Sequence: Synthetic oligonucleotide
  Description of Combined DNA/RNA Molecule: Synthetic oligonucleotide
gugcuuucaugucaucuucaauaucca

SEQ ID NO: 2117 - RNA, 27 nt, Artificial Sequence
  Description of Artificial Sequence: Synthetic oligonucleotide
  Description of Combined DNA/RNA Molecule: Synthetic oligonucleotide
ugugcuuucaugucaucuucaauaucc

SEQ ID NO: 2118 - RNA, 27 nt, Artificial Sequence
  Description of Artificial Sequence: Synthetic oligonucleotide
  Description of Combined DNA/RNA Molecule: Synthetic oligonucleotide
auucaucugugcuuucaugucaucuuc

SEQ ID NO: 2119 - RNA, 27 nt, Artificial Sequence
  Description of Artificial Sequence: Synthetic oligonucleotide
  Description of Combined DNA/RNA Molecule: Synthetic oligonucleotide
aauucaucugugcuuucaugucaucuu

SEQ ID NO: 2120 - RNA, 27 nt, Artificial Sequence
  Description of Artificial Sequence: Synthetic oligonucleotide
  Description of Combined DNA/RNA Molecule: Synthetic oligonucleotide
aauaaaagcaauucaucugugcuuuca

SEQ ID NO: 2121 - RNA, 27 nt, Artificial Sequence
  Description of Artificial Sequence: Synthetic oligonucleotide
  Description of Combined DNA/RNA Molecule: Synthetic oligonucleotide
cuuucaaauaaaagcaauucaucugug

SEQ ID NO: 2122 - RNA, 27 nt, Artificial Sequence
  Description of Artificial Sequence: Synthetic oligonucleotide
  Description of Combined DNA/RNA Molecule: Synthetic oligonucleotide
gcuuucaaauaaaagcaauucaucugu

SEQ ID NO: 2123 - RNA, 27 nt, Artificial Sequence
  Description of Artificial Sequence: Synthetic oligonucleotide
  Description of Combined DNA/RNA Molecule: Synthetic oligonucleotide
aaaaccauccaaggcuuucaaauaaaa

SEQ ID NO: 2124 - RNA, 27 nt, Artificial Sequence
  Description of Artificial Sequence: Synthetic oligonucleotide
  Description of Combined DNA/RNA Molecule: Synthetic oligonucleotide
caaaaccauccaaggcuuucaaauaaa

SEQ ID NO: 2125 - RNA, 27 nt, Artificial Sequence
  Description of Artificial Sequence: Synthetic oligonucleotide
  Description of Combined DNA/RNA Molecule: Synthetic oligonucleotide
ccauaacaaaaccauccaaggcuuuca

SEQ ID NO: 2126 - RNA, 27 nt, Artificial Sequence
  Description of Artificial Sequence: Synthetic oligonucleotide
  Description of Combined DNA/RNA Molecule: Synthetic oligonucleotide
caucaucugugagaaccauaacaaaac

SEQ ID NO: 2127 - RNA, 27 nt, Artificial Sequence
  Description of Artificial Sequence: Synthetic oligonucleotide
  Description of Combined DNA/RNA Molecule: Synthetic oligonucleotide
ugucaccaucaucugugagaaccauaa

SEQ ID NO: 2128 - RNA, 27 nt, Artificial Sequence
  Description of Artificial Sequence: Synthetic oligonucleotide
  Description of Combined DNA/RNA Molecule: Synthetic oligonucleotide
augucaccaucaucugugagaaccaua

SEQ ID NO: 2129 - RNA, 27 nt, Artificial Sequence
  Description of Artificial Sequence: Synthetic oligonucleotide
  Description of Combined DNA/RNA Molecule: Synthetic oligonucleotide
auguaaaucaugucaccaucaucugug

SEQ ID NO: 2130 - RNA, 27 nt, Artificial Sequence
  Description of Artificial Sequence: Synthetic oligonucleotide
  Description of Combined DNA/RNA Molecule: Synthetic oligonucleotide
cagaaauguaaaucaugucaccaucau

SEQ ID NO: 2131 - RNA, 27 nt, Artificial Sequence
  Description of Artificial Sequence: Synthetic oligonucleotide
  Description of Combined DNA/RNA Molecule: Synthetic oligonucleotide
ucagaaauguaaaucaugucaccauca

SEQ ID NO: 2132 - RNA, 27 nt, Artificial Sequence
  Description of Artificial Sequence: Synthetic oligonucleotide
  Description of Combined DNA/RNA Molecule: Synthetic oligonucleotide
ucacauuaucagaaauguaaaucaugu

SEQ ID NO: 2133 - RNA, 27 nt, Artificial Sequence
  Description of Artificial Sequence: Synthetic oligonucleotide
  Description of Combined DNA/RNA Molecule: Synthetic oligonucleotide
guucacauuaucagaaauguaaaucau

SEQ ID NO: 2134 - RNA, 27 nt, Artificial Sequence
  Description of Artificial Sequence: Synthetic oligonucleotide
  Description of Combined DNA/RNA Molecule: Synthetic oligonucleotide
uuguucacauuaucagaaauguaaauc

SEQ ID NO: 2135 - RNA, 27 nt, Artificial Sequence
  Description of Artificial Sequence: Synthetic oligonucleotide
  Description of Combined DNA/RNA Molecule: Synthetic oligonucleotide
uguauuuguucacauuaucagaaaugu

SEQ ID NO: 2136 - RNA, 27 nt, Artificial Sequence
  Description of Artificial Sequence: Synthetic oligonucleotide
  Description of Combined DNA/RNA Molecule: Synthetic oligonucleotide
uaaucccauguauuuguucacauuauc

SEQ ID NO: 2137 - RNA, 27 nt, Artificial Sequence
  Description of Artificial Sequence: Synthetic oligonucleotide
  Description of Combined DNA/RNA Molecule: Synthetic oligonucleotide
uuaaucccauguauuuguucacauuau

SEQ ID NO: 2138 - RNA, 27 nt, Artificial Sequence
  Description of Artificial Sequence: Synthetic oligonucleotide
  Description of Combined DNA/RNA Molecule: Synthetic oligonucleotide
guuaaucccauguauuuguucacauua

SEQ ID NO: 2139 - RNA, 27 nt, Artificial Sequence
  Description of Artificial Sequence: Synthetic oligonucleotide
  Description of Combined DNA/RNA Molecule: Synthetic oligonucleotide
aguuaaucccauguauuuguucacauu

SEQ ID NO: 2140 - RNA, 27 nt, Artificial Sequence
  Description of Artificial Sequence: Synthetic oligonucleotide
  Description of Combined DNA/RNA Molecule: Synthetic oligonucleotide
gaguuaaucccauguauuuguucacau

SEQ ID NO: 2141 - RNA, 27 nt, Artificial Sequence
  Description of Artificial Sequence: Synthetic oligonucleotide
  Description of Combined DNA/RNA Molecule: Synthetic oligonucleotide
ugaguuaaucccauguauuuguucaca

SEQ ID NO: 2142 - RNA, 27 nt, Artificial Sequence
  Description of Artificial Sequence: Synthetic oligonucleotide
  Description of Combined DNA/RNA Molecule: Synthetic oligonucleotide
uaguucaaacugaguuaaucccaugua

SEQ ID NO: 2143 - RNA, 27 nt, Artificial Sequence
  Description of Artificial Sequence: Synthetic oligonucleotide
  Description of Combined DNA/RNA Molecule: Synthetic oligonucleotide
uuaguucaaacugaguuaaucccaugu

SEQ ID NO: 2144 - RNA, 27 nt, Artificial Sequence
  Description of Artificial Sequence: Synthetic oligonucleotide
  Description of Combined DNA/RNA Molecule: Synthetic oligonucleotide
acacacuguguccaguuaguucaaacu

SEQ ID NO: 2145 - RNA, 27 nt, Artificial Sequence
  Description of Artificial Sequence: Synthetic oligonucleotide
  Description of Combined DNA/RNA Molecule: Synthetic oligonucleotide
guaaaaucaaacacacuguguccaguu

SEQ ID NO: 2146 - RNA, 27 nt, Artificial Sequence
  Description of Artificial Sequence: Synthetic oligonucleotide
  Description of Combined DNA/RNA Molecule: Synthetic oligonucleotide
aguaaaaucaaacacacuguguccagu

SEQ ID NO: 2147 - RNA, 27 nt, Artificial Sequence
  Description of Artificial Sequence: Synthetic oligonucleotide
  Description of Combined DNA/RNA Molecule: Synthetic oligonucleotide
ggucacauggaugaguaaaaucaaaca

SEQ ID NO: 2148 - RNA, 27 nt, Artificial Sequence
  Description of Artificial Sequence: Synthetic oligonucleotide
  Description of Combined DNA/RNA Molecule: Synthetic oligonucleotide
auggucacauggaugaguaaaaucaaa

SEQ ID NO: 2149 - RNA, 27 nt, Artificial Sequence
  Description of Artificial Sequence: Synthetic oligonucleotide
  Description of Combined DNA/RNA Molecule: Synthetic oligonucleotide
ucucucauuuccucauggucacaugga

SEQ ID NO: 2150 - RNA, 27 nt, Artificial Sequence
  Description of Artificial Sequence: Synthetic oligonucleotide
  Description of Combined DNA/RNA Molecule: Synthetic oligonucleotide
uuucucucauuuccucauggucacaug

SEQ ID NO: 2151 - RNA, 27 nt, Artificial Sequence
  Description of Artificial Sequence: Synthetic oligonucleotide
  Description of Combined DNA/RNA Molecule: Synthetic oligonucleotide
uaagcauuucucucauuuccucauggu

SEQ ID NO: 2152 - RNA, 27 nt, Artificial Sequence
  Description of Artificial Sequence: Synthetic oligonucleotide
  Description of Combined DNA/RNA Molecule: Synthetic oligonucleotide
cauuucuguguguaagcauuucucuca

SEQ ID NO: 2153 - RNA, 27 nt, Artificial Sequence
  Description of Artificial Sequence: Synthetic oligonucleotide
  Description of Combined DNA/RNA Molecule: Synthetic oligonucleotide
aggccauuucuguguguaagcauuucu

SEQ ID NO: 2154 - RNA, 27 nt, Artificial Sequence
  Description of Artificial Sequence: Synthetic oligonucleotide
  Description of Combined DNA/RNA Molecule: Synthetic oligonucleotide
aaggccauuucuguguguaagcauuuc

SEQ ID NO: 2155 - RNA, 27 nt, Artificial Sequence
  Description of Artificial Sequence: Synthetic oligonucleotide
  Description of Combined DNA/RNA Molecule: Synthetic oligonucleotide
uuacccuuuuucacaaggccauuucug

SEQ ID NO: 2156 - RNA, 27 nt, Artificial Sequence
  Description of Artificial Sequence: Synthetic oligonucleotide
  Description of Combined DNA/RNA Molecule: Synthetic oligonucleotide
uuuacccuuuuucacaaggccauuucu

SEQ ID NO: 2157 - RNA, 27 nt, Artificial Sequence
  Description of Artificial Sequence: Synthetic oligonucleotide
  Description of Combined DNA/RNA Molecule: Synthetic oligonucleotide
cuuuacccuuuuucacaaggccauuuc

SEQ ID NO: 2158 - RNA, 27 nt, Artificial Sequence
  Description of Artificial Sequence: Synthetic oligonucleotide
  Description of Combined DNA/RNA Molecule: Synthetic oligonucleotide
ucuuuacccuuuuucacaaggccauuu

SEQ ID NO: 2159 - RNA, 27 nt, Artificial Sequence
  Description of Artificial Sequence: Synthetic oligonucleotide
  Description of Combined DNA/RNA Molecule: Synthetic oligonucleotide
uuuguucuuuacccuuuuucacaaggc

SEQ ID NO: 2160 - RNA, 27 nt, Artificial Sequence
  Description of Artificial Sequence: Synthetic oligonucleotide
  Description of Combined DNA/RNA Molecule: Synthetic oligonucleotide
aagcuucgcuguguguuuuguucuuua

SEQ ID NO: 2161 - RNA, 27 nt, Artificial Sequence
  Description of Artificial Sequence: Synthetic oligonucleotide
  Description of Combined DNA/RNA Molecule: Synthetic oligonucleotide
gguacacuucauucugagaaaaaagcu

SEQ ID NO: 2162 - RNA, 27 nt, Artificial Sequence
  Description of Artificial Sequence: Synthetic oligonucleotide
  Description of Combined DNA/RNA Molecule: Synthetic oligonucleotide
aggguacacuucauucugagaaaaaag

SEQ ID NO: 2163 - RNA, 27 nt, Artificial Sequence
  Description of Artificial Sequence: Synthetic oligonucleotide
  Description of Combined DNA/RNA Molecule: Synthetic oligonucleotide
ucggcuaguuaggguacacuucauucu

SEQ ID NO: 2164 - RNA, 27 nt, Artificial Sequence
  Description of Artificial Sequence: Synthetic oligonucleotide
  Description of Combined DNA/RNA Molecule: Synthetic oligonucleotide
agacuuuauguucauaguucuuccucg

SEQ ID NO: 2165 - RNA, 27 nt, Artificial Sequence
  Description of Artificial Sequence: Synthetic oligonucleotide
  Description of Combined DNA/RNA Molecule: Synthetic oligonucleotide
cagacuuuauguucauaguucuuccuc

SEQ ID NO: 2166 - RNA, 27 nt, Artificial Sequence
  Description of Artificial Sequence: Synthetic oligonucleotide
  Description of Combined DNA/RNA Molecule: Synthetic oligonucleotide
gcagacuuuauguucauaguucuuccu

SEQ ID NO: 2167 - RNA, 27 nt, Artificial Sequence
  Description of Artificial Sequence: Synthetic oligonucleotide
  Description of Combined DNA/RNA Molecule: Synthetic oligonucleotide
guaucauauacgugaauguggccugug

SEQ ID NO: 2168 - RNA, 27 nt, Artificial Sequence
  Description of Artificial Sequence: Synthetic oligonucleotide
  Description of Combined DNA/RNA Molecule: Synthetic oligonucleotide
ggucauaggugguuucuuauacccaca

SEQ ID NO: 2169 - RNA, 27 nt, Artificial Sequence
  Description of Artificial Sequence: Synthetic oligonucleotide
  Description of Combined DNA/RNA Molecule: Synthetic oligonucleotide
aggucauaggugguuucuuauacccac

SEQ ID NO: 2170 - RNA, 27 nt, Artificial Sequence
  Description of Artificial Sequence: Synthetic oligonucleotide
  Description of Combined DNA/RNA Molecule: Synthetic oligonucleotide
uugcuaucuaaaggaauuucaauauuu

SEQ ID NO: 2171 - RNA, 27 nt, Artificial Sequence
  Description of Artificial Sequence: Synthetic oligonucleotide
  Description of Combined DNA/RNA Molecule: Synthetic oligonucleotide
aaagucuugcuaucuaaaggaauuuca

SEQ ID NO: 2172 - RNA, 27 nt, Artificial Sequence
  Description of Artificial Sequence: Synthetic oligonucleotide
  Description of Combined DNA/RNA Molecule: Synthetic oligonucleotide
caucacaauaagaaaauuucauaucca

SEQ ID NO: 2173 - RNA, 27 nt, Artificial Sequence
  Description of Artificial Sequence: Synthetic oligonucleotide
  Description of Combined DNA/RNA Molecule: Synthetic oligonucleotide
uuucaucacaauaagaaaauuucauau

SEQ ID NO: 2174 - RNA, 27 nt, Artificial Sequence
  Description of Artificial Sequence: Synthetic oligonucleotide
  Description of Combined DNA/RNA Molecule: Synthetic oligonucleotide
cuuucaucacaauaagaaaauuucaua

SEQ ID NO: 2175 - RNA, 27 nt, Artificial Sequence
  Description of Artificial Sequence: Synthetic oligonucleotide
  Description of Combined DNA/RNA Molecule: Synthetic oligonucleotide
ucuuucaucacaauaagaaaauuucau

SEQ ID NO: 2176 - RNA, 27 nt, Artificial Sequence
  Description of Artificial Sequence: Synthetic oligonucleotide
  Description of Combined DNA/RNA Molecule: Synthetic oligonucleotide
auucuuucaucacaauaagaaaauuuc

SEQ ID NO: 2177 - RNA, 27 nt, Artificial Sequence
  Description of Artificial Sequence: Synthetic oligonucleotide
  Description of Combined DNA/RNA Molecule: Synthetic oligonucleotide
aauucuuucaucacaauaagaaaauuu

SEQ ID NO: 2178 - RNA, 27 nt, Artificial Sequence
  Description of Artificial Sequence: Synthetic oligonucleotide
  Description of Combined DNA/RNA Molecule: Synthetic oligonucleotide
uaauucuuucaucacaauaagaaaauu

SEQ ID NO: 2179 - RNA, 27 nt, Artificial Sequence
  Description of Artificial Sequence: Synthetic oligonucleotide
  Description of Combined DNA/RNA Molecule: Synthetic oligonucleotide
ucgguaauucuuucaucacaauaagaa

SEQ ID NO: 2180 - RNA, 27 nt, Artificial Sequence
  Description of Artificial Sequence: Synthetic oligonucleotide
  Description of Combined DNA/RNA Molecule: Synthetic oligonucleotide
ucaauucgguaauucuuucaucacaau

SEQ ID NO: 2181 - RNA, 27 nt, Artificial Sequence
  Description of Artificial Sequence: Synthetic oligonucleotide
  Description of Combined DNA/RNA Molecule: Synthetic oligonucleotide
caucaauucgguaauucuuucaucaca

SEQ ID NO: 2182 - RNA, 27 nt, Artificial Sequence
  Description of Artificial Sequence: Synthetic oligonucleotide
  Description of Combined DNA/RNA Molecule: Synthetic oligonucleotide
uaucccaucaauucgguaauucuuuca

SEQ ID NO: 2183 - RNA, 27 nt, Artificial Sequence
  Description of Artificial Sequence: Synthetic oligonucleotide
  Description of Combined DNA/RNA Molecule: Synthetic oligonucleotide
auaucccaucaauucgguaauucuuuc

SEQ ID NO: 2184 - RNA, 27 nt, Artificial Sequence
  Description of Artificial Sequence: Synthetic oligonucleotide
  Description of Combined DNA/RNA Molecule: Synthetic oligonucleotide
cauaucccaucaauucgguaauucuuu

SEQ ID NO: 2185 - RNA, 27 nt, Artificial Sequence
  Description of Artificial Sequence: Synthetic oligonucleotide
  Description of Combined DNA/RNA Molecule: Synthetic oligonucleotide
ucauaucccaucaauucgguaauucuu

SEQ ID NO: 2186 - RNA, 27 nt, Artificial Sequence
  Description of Artificial Sequence: Synthetic oligonucleotide
  Description of Combined DNA/RNA Molecule: Synthetic oligonucleotide
aaaguucuucuggcucauaucccauca

SEQ ID NO: 2187 - RNA, 27 nt, Artificial Sequence
  Description of Artificial Sequence: Synthetic oligonucleotide
  Description of Combined DNA/RNA Molecule: Synthetic oligonucleotide
cggccuaaaaguucuucuggcucauau

SEQ ID NO: 2188 - RNA, 27 nt, Artificial Sequence
  Description of Artificial Sequence: Synthetic oligonucleotide
  Description of Combined DNA/RNA Molecule: Synthetic oligonucleotide
uaauauucauaaauugagcggccuaaa

SEQ ID NO: 2189 - RNA, 27 nt, Artificial Sequence
  Description of Artificial Sequence: Synthetic oligonucleotide
  Description of Combined DNA/RNA Molecule: Synthetic oligonucleotide
aguccaaagcaugauaauauucauaaa

SEQ ID NO: 2190 - RNA, 27 nt, Artificial Sequence
  Description of Artificial Sequence: Synthetic oligonucleotide
  Description of Combined DNA/RNA Molecule: Synthetic oligonucleotide
agaguccaaagcaugauaauauucaua

SEQ ID NO: 2191 - RNA, 27 nt, Artificial Sequence
  Description of Artificial Sequence: Synthetic oligonucleotide
  Description of Combined DNA/RNA Molecule: Synthetic oligonucleotide
acauaucaugaugaguuuuggucagau

SEQ ID NO: 2192 - RNA, 27 nt, Artificial Sequence
  Description of Artificial Sequence: Synthetic oligonucleotide
  Description of Combined DNA/RNA Molecule: Synthetic oligonucleotide
aguaaacauaucaugaugaguuuuggu

SEQ ID NO: 2193 - RNA, 27 nt, Artificial Sequence
  Description of Artificial Sequence: Synthetic oligonucleotide
  Description of Combined DNA/RNA Molecule: Synthetic oligonucleotide
uaguaaacauaucaugaugaguuuugg

SEQ ID NO: 2194 - RNA, 27 nt, Artificial Sequence
  Description of Artificial Sequence: Synthetic oligonucleotide
  Description of Combined DNA/RNA Molecule: Synthetic oligonucleotide
cuuguccuuuaguaaacauaucaugau

SEQ ID NO: 2195 - RNA, 27 nt, Artificial Sequence
  Description of Artificial Sequence: Synthetic oligonucleotide
  Description of Combined DNA/RNA Molecule: Synthetic oligonucleotide
gugacuuguccuuuaguaaacauauca

SEQ ID NO: 2196 - RNA, 27 nt, Artificial Sequence
  Description of Artificial Sequence: Synthetic oligonucleotide
  Description of Combined DNA/RNA Molecule: Synthetic oligonucleotide
gaguuucaacccagacauauccaccuc

SEQ ID NO: 2197 - RNA, 27 nt, Artificial Sequence
  Description of Artificial Sequence: Synthetic oligonucleotide
  Description of Combined DNA/RNA Molecule: Synthetic oligonucleotide
uaugacaguugcuugaguuucaaccca

SEQ ID NO: 2198 - RNA, 27 nt, Artificial Sequence
  Description of Artificial Sequence: Synthetic oligonucleotide
  Description of Combined DNA/RNA Molecule: Synthetic oligonucleotide
gaauucuugguguuauauaugacaguu

SEQ ID NO: 2199 - RNA, 27 nt, Artificial Sequence
  Description of Artificial Sequence: Synthetic oligonucleotide
  Description of Combined DNA/RNA Molecule: Synthetic oligonucleotide
aaugcacugugguugagaauucuuggu

SEQ ID NO: 2200 - RNA, 27 nt, Artificial Sequence
  Description of Artificial Sequence: Synthetic oligonucleotide
  Description of Combined DNA/RNA Molecule: Synthetic oligonucleotide
cguaauucacacauacaaugcacugug

SEQ ID NO: 2201 - RNA, 27 nt, Artificial Sequence
  Description of Artificial Sequence: Synthetic oligonucleotide
  Description of Combined DNA/RNA Molecule: Synthetic oligonucleotide
acguaauucacacauacaaugcacugu

SEQ ID NO: 2202 - RNA, 27 nt, Artificial Sequence
  Description of Artificial Sequence: Synthetic oligonucleotide
  Description of Combined DNA/RNA Molecule: Synthetic oligonucleotide
auaccacucacaacguaauucacacau

SEQ ID NO: 2203 - RNA, 27 nt, Artificial Sequence
  Description of Artificial Sequence: Synthetic oligonucleotide
  Description of Combined DNA/RNA Molecule: Synthetic oligonucleotide
aauaccacucacaacguaauucacaca

SEQ ID NO: 2204 - RNA, 27 nt, Artificial Sequence
  Description of Artificial Sequence: Synthetic oligonucleotide
  Description of Combined DNA/RNA Molecule: Synthetic oligonucleotide
uaauaccacucacaacguaauucacac

SEQ ID NO: 2205 - RNA, 27 nt, Artificial Sequence
  Description of Artificial Sequence: Synthetic oligonucleotide
  Description of Combined DNA/RNA Molecule: Synthetic oligonucleotide
auaauaccacucacaacguaauucaca

SEQ ID NO: 2206 - RNA, 27 nt, Artificial Sequence
  Description of Artificial Sequence: Synthetic oligonucleotide
  Description of Combined DNA/RNA Molecule: Synthetic oligonucleotide
aaaaucaagucgugcugaauaauacca

SEQ ID NO: 2207 - RNA, 27 nt, Artificial Sequence
  Description of Artificial Sequence: Synthetic oligonucleotide
  Description of Combined DNA/RNA Molecule: Synthetic oligonucleotide
ucuguuuguugaagggagaaaaucaag

SEQ ID NO: 2208 - RNA, 27 nt, Artificial Sequence
  Description of Artificial Sequence: Synthetic oligonucleotide
  Description of Combined DNA/RNA Molecule: Synthetic oligonucleotide
ccgguuuaaggacacauucuguuuguu

SEQ ID NO: 2209 - RNA, 27 nt, Artificial Sequence
  Description of Artificial Sequence: Synthetic oligonucleotide
  Description of Combined DNA/RNA Molecule: Synthetic oligonucleotide
aagauucaaccgguuuaaggacacauu

SEQ ID NO: 2210 - RNA, 27 nt, Artificial Sequence
  Description of Artificial Sequence: Synthetic oligonucleotide
  Description of Combined DNA/RNA Molecule: Synthetic oligonucleotide
auuuucauaucugaagauucaaccggu

SEQ ID NO: 2211 - RNA, 27 nt, Artificial Sequence
  Description of Artificial Sequence: Synthetic oligonucleotide
  Description of Combined DNA/RNA Molecule: Synthetic oligonucleotide
cauuuucauaucugaagauucaaccgg

SEQ ID NO: 2212 - RNA, 27 nt, Artificial Sequence
  Description of Artificial Sequence: Synthetic oligonucleotide
  Description of Combined DNA/RNA Molecule: Synthetic oligonucleotide
ucauuuucauaucugaagauucaaccg

SEQ ID NO: 2213 - RNA, 27 nt, Artificial Sequence
  Description of Artificial Sequence: Synthetic oligonucleotide
  Description of Combined DNA/RNA Molecule: Synthetic oligonucleotide
agucauuuucauaucugaagauucaac

SEQ ID NO: 2214 - RNA, 27 nt, Artificial Sequence
  Description of Artificial Sequence: Synthetic oligonucleotide
  Description of Combined DNA/RNA Molecule: Synthetic oligonucleotide
gagucauuuucauaucugaagauucaa

SEQ ID NO: 2215 - RNA, 27 nt, Artificial Sequence
  Description of Artificial Sequence: Synthetic oligonucleotide
  Description of Combined DNA/RNA Molecule: Synthetic oligonucleotide
gugaauagcugagucauuuucauaucu

SEQ ID NO: 2216 - RNA, 27 nt, Artificial Sequence
  Description of Artificial Sequence: Synthetic oligonucleotide
  Description of Combined DNA/RNA Molecule: Synthetic oligonucleotide
ggugaauagcugagucauuuucauauc

SEQ ID NO: 2217 - RNA, 27 nt, Artificial Sequence
  Description of Artificial Sequence: Synthetic oligonucleotide
  Description of Combined DNA/RNA Molecule: Synthetic oligonucleotide
gcuacuuguaucuucugauucaacuuu

SEQ ID NO: 2218 - RNA, 27 nt, Artificial Sequence
  Description of Artificial Sequence: Synthetic oligonucleotide
  Description of Combined DNA/RNA Molecule: Synthetic oligonucleotide
aggcuacuuguaucuucugauucaacu

SEQ ID NO: 2219 - RNA, 27 nt, Artificial Sequence
  Description of Artificial Sequence: Synthetic oligonucleotide
  Description of Combined DNA/RNA Molecule: Synthetic oligonucleotide
ugucaaagaggcuacuuguaucuucug

SEQ ID NO: 2220 - RNA, 27 nt, Artificial Sequence
  Description of Artificial Sequence: Synthetic oligonucleotide
  Description of Combined DNA/RNA Molecule: Synthetic oligonucleotide
uugucaaagaggcuacuuguaucuucu

SEQ ID NO: 2221 - RNA, 27 nt, Artificial Sequence
  Description of Artificial Sequence: Synthetic oligonucleotide
  Description of Combined DNA/RNA Molecule: Synthetic oligonucleotide
uuugucaaagaggcuacuuguaucuuc

SEQ ID NO: 2222 - RNA, 27 nt, Artificial Sequence
  Description of Artificial Sequence: Synthetic oligonucleotide
  Description of Combined DNA/RNA Molecule: Synthetic oligonucleotide
agguuccuucuuaaguuugucaaagag

SEQ ID NO: 2223 - RNA, 27 nt, Artificial Sequence
  Description of Artificial Sequence: Synthetic oligonucleotide
  Description of Combined DNA/RNA Molecule: Synthetic oligonucleotide
cagguuccuucuuaaguuugucaaaga

SEQ ID NO: 2224 - RNA, 27 nt, Artificial Sequence
  Description of Artificial Sequence: Synthetic oligonucleotide
  Description of Combined DNA/RNA Molecule: Synthetic oligonucleotide
ggggccagcaaaguuaaagcaucaggu

SEQ ID NO: 2225 - RNA, 27 nt, Artificial Sequence
  Description of Artificial Sequence: Synthetic oligonucleotide
  Description of Combined DNA/RNA Molecule: Synthetic oligonucleotide
aaucuaaagauaugauugugucuccag

SEQ ID NO: 2226 - RNA, 27 nt, Artificial Sequence
  Description of Artificial Sequence: Synthetic oligonucleotide
  Description of Combined DNA/RNA Molecule: Synthetic oligonucleotide
aaaucuaaagauaugauugugucucca

SEQ ID NO: 2227 - RNA, 27 nt, Artificial Sequence
  Description of Artificial Sequence: Synthetic oligonucleotide
  Description of Combined DNA/RNA Molecule: Synthetic oligonucleotide
cauuauauaaugguacuuccucaaguu

SEQ ID NO: 2228 - RNA, 27 nt, Artificial Sequence
  Description of Artificial Sequence: Synthetic oligonucleotide
  Description of Combined DNA/RNA Molecule: Synthetic oligonucleotide
ucauuauauaaugguacuuccucaagu

SEQ ID NO: 2229 - RNA, 27 nt, Artificial Sequence
  Description of Artificial Sequence: Synthetic oligonucleotide
  Description of Combined DNA/RNA Molecule: Synthetic oligonucleotide
caucauuauauaaugguacuuccucaa

SEQ ID NO: 2230 - RNA, 27 nt, Artificial Sequence
  Description of Artificial Sequence: Synthetic oligonucleotide
  Description of Combined DNA/RNA Molecule: Synthetic oligonucleotide
acaucauuauauaaugguacuuccuca

SEQ ID NO: 2231 - RNA, 27 nt, Artificial Sequence
  Description of Artificial Sequence: Synthetic oligonucleotide
  Description of Combined DNA/RNA Molecule: Synthetic oligonucleotide
uuacaucauuauauaaugguacuuccu

SEQ ID NO: 2232 - RNA, 27 nt, Artificial Sequence
  Description of Artificial Sequence: Synthetic oligonucleotide
  Description of Combined DNA/RNA Molecule: Synthetic oligonucleotide
auuacaucauuauauaaugguacuucc

SEQ ID NO: 2233 - RNA, 27 nt, Artificial Sequence
  Description of Artificial Sequence: Synthetic oligonucleotide
  Description of Combined DNA/RNA Molecule: Synthetic oligonucleotide
caaauuuauauucuguaauuuuucguu

SEQ ID NO: 2234 - RNA, 27 nt, Artificial Sequence
  Description of Artificial Sequence: Synthetic oligonucleotide
  Description of Combined DNA/RNA Molecule: Synthetic oligonucleotide
ccaaauuuauauucuguaauuuuucgu

SEQ ID NO: 2235 - RNA, 27 nt, Artificial Sequence
  Description of Artificial Sequence: Synthetic oligonucleotide
  Description of Combined DNA/RNA Molecule: Synthetic oligonucleotide
uugccaaauuuauauucuguaauuuuu

SEQ ID NO: 2236 - RNA, 27 nt, Artificial Sequence
  Description of Artificial Sequence: Synthetic oligonucleotide
  Description of Combined DNA/RNA Molecule: Synthetic oligonucleotide
gagacauugccaaauuuauauucugua

SEQ ID NO: 2237 - RNA, 27 nt, Artificial Sequence
  Description of Artificial Sequence: Synthetic oligonucleotide
  Description of Combined DNA/RNA Molecule: Synthetic oligonucleotide
ggagacauugccaaauuuauauucugu

SEQ ID NO: 2238 - RNA, 27 nt, Artificial Sequence
  Description of Artificial Sequence: Synthetic oligonucleotide
  Description of Combined DNA/RNA Molecule: Synthetic oligonucleotide
guucuaauuuuaaugcaacuucuugau

SEQ ID NO: 2239 - RNA, 27 nt, Artificial Sequence
  Description of Artificial Sequence: Synthetic oligonucleotide
  Description of Combined DNA/RNA Molecule: Synthetic oligonucleotide
gguucuaauuuuaaugcaacuucuuga

SEQ ID NO: 2240 - RNA, 27 nt, Artificial Sequence
  Description of Artificial Sequence: Synthetic oligonucleotide
  Description of Combined DNA/RNA Molecule: Synthetic oligonucleotide
gugacucuggauuugguucuaauuuua

SEQ ID NO: 2241 - RNA, 27 nt, Artificial Sequence
  Description of Artificial Sequence: Synthetic oligonucleotide
  Description of Combined DNA/RNA Molecule: Synthetic oligonucleotide
agugacucuggauuugguucuaauuuu

SEQ ID NO: 2242 - RNA, 27 nt, Artificial Sequence
  Description of Artificial Sequence: Synthetic oligonucleotide
  Description of Combined DNA/RNA Molecule: Synthetic oligonucleotide
gguaaaagaaaguuccagugacucugg

SEQ ID NO: 2243 - RNA, 27 nt, Artificial Sequence
  Description of Artificial Sequence: Synthetic oligonucleotide
  Description of Combined DNA/RNA Molecule: Synthetic oligonucleotide
ugguaaaagaaaguuccagugacucug

SEQ ID NO: 2244 - RNA, 27 nt, Artificial Sequence
  Description of Artificial Sequence: Synthetic oligonucleotide
  Description of Combined DNA/RNA Molecule: Synthetic oligonucleotide
ggggcaugguaaaagaaaguuccagug

SEQ ID NO: 2245 - RNA, 27 nt, Artificial Sequence
  Description of Artificial Sequence: Synthetic oligonucleotide
  Description of Combined DNA/RNA Molecule: Synthetic oligonucleotide
aaacaauauucacugggacuauuaggc

SEQ ID NO: 2246 - RNA, 27 nt, Artificial Sequence
  Description of Artificial Sequence: Synthetic oligonucleotide
  Description of Combined DNA/RNA Molecule: Synthetic oligonucleotide
aaaacaauauucacugggacuauuagg

SEQ ID NO: 2247 - RNA, 27 nt, Artificial Sequence
  Description of Artificial Sequence: Synthetic oligonucleotide
  Description of Combined DNA/RNA Molecule: Synthetic oligonucleotide
aaaaacaauauucacugggacuauuag

SEQ ID NO: 2248 - RNA, 27 nt, Artificial Sequence
  Description of Artificial Sequence: Synthetic oligonucleotide
  Description of Combined DNA/RNA Molecule: Synthetic oligonucleotide
uaaaaacaauauucacugggacuauua

SEQ ID NO: 2249 - RNA, 27 nt, Artificial Sequence
  Description of Artificial Sequence: Synthetic oligonucleotide
  Description of Combined DNA/RNA Molecule: Synthetic oligonucleotide
auaaaaacaauauucacugggacuauu

SEQ ID NO: 2250 - RNA, 27 nt, Artificial Sequence
  Description of Artificial Sequence: Synthetic oligonucleotide
  Description of Combined DNA/RNA Molecule: Synthetic oligonucleotide
cuauccacauaaaaacaauauucacug

SEQ ID NO: 2251 - RNA, 27 nt, Artificial Sequence
  Description of Artificial Sequence: Synthetic oligonucleotide
  Description of Combined DNA/RNA Molecule: Synthetic oligonucleotide
acuauccacauaaaaacaauauucacu

SEQ ID NO: 2252 - RNA, 27 nt, Artificial Sequence
  Description of Artificial Sequence: Synthetic oligonucleotide
  Description of Combined DNA/RNA Molecule: Synthetic oligonucleotide
ucacuauccacauaaaaacaauauuca

SEQ ID NO: 2253 - RNA, 27 nt, Artificial Sequence
  Description of Artificial Sequence: Synthetic oligonucleotide
  Description of Combined DNA/RNA Molecule: Synthetic oligonucleotide
uaucacuauccacauaaaaacaauauu

SEQ ID NO: 2254 - RNA, 27 nt, Artificial Sequence
  Description of Artificial Sequence: Synthetic oligonucleotide
  Description of Combined DNA/RNA Molecule: Synthetic oligonucleotide
auaucacuauccacauaaaaacaauau

SEQ ID NO: 2255 - RNA, 27 nt, Artificial Sequence
  Description of Artificial Sequence: Synthetic oligonucleotide
  Description of Combined DNA/RNA Molecule: Synthetic oligonucleotide
ccauaucacuauccacauaaaaacaau

SEQ ID NO: 2256 - RNA, 27 nt, Artificial Sequence
  Description of Artificial Sequence: Synthetic oligonucleotide
  Description of Combined DNA/RNA Molecule: Synthetic oligonucleotide
ugaccauaucacuauccacauaaaaac

SEQ ID NO: 2257 - RNA, 27 nt, Artificial Sequence
  Description of Artificial Sequence: Synthetic oligonucleotide
  Description of Combined DNA/RNA Molecule: Synthetic oligonucleotide
aauucauugaccauaucacuauccaca

SEQ ID NO: 2258 - RNA, 27 nt, Artificial Sequence
  Description of Artificial Sequence: Synthetic oligonucleotide
  Description of Combined DNA/RNA Molecule: Synthetic oligonucleotide
ugaauucauugaccauaucacuaucca

SEQ ID NO: 2259 - RNA, 27 nt, Artificial Sequence
  Description of Artificial Sequence: Synthetic oligonucleotide
  Description of Combined DNA/RNA Molecule: Synthetic oligonucleotide
uugaauucauugaccauaucacuaucc

SEQ ID NO: 2260 - RNA, 27 nt, Artificial Sequence
  Description of Artificial Sequence: Synthetic oligonucleotide
  Description of Combined DNA/RNA Molecule: Synthetic oligonucleotide
cuugaauucauugaccauaucacuauc

SEQ ID NO: 2261 - RNA, 27 nt, Artificial Sequence
  Description of Artificial Sequence: Synthetic oligonucleotide
  Description of Combined DNA/RNA Molecule: Synthetic oligonucleotide
ccaacuugaauucauugaccauaucac

SEQ ID NO: 2262 - RNA, 27 nt, Artificial Sequence
  Description of Artificial Sequence: Synthetic oligonucleotide
  Description of Combined DNA/RNA Molecule: Synthetic oligonucleotide
auuccaacuugaauucauugaccauau

SEQ ID NO: 2263 - RNA, 27 nt, Artificial Sequence
  Description of Artificial Sequence: Synthetic oligonucleotide
  Description of Combined DNA/RNA Molecule: Synthetic oligonucleotide
aauuccaacuugaauucauugaccaua

SEQ ID NO: 2264 - RNA, 27 nt, Artificial Sequence
  Description of Artificial Sequence: Synthetic oligonucleotide
  Description of Combined DNA/RNA Molecule: Synthetic oligonucleotide
cuaccaauuccaacuugaauucauuga

SEQ ID NO: 2265 - RNA, 27 nt, Artificial Sequence
  Description of Artificial Sequence: Synthetic oligonucleotide
  Description of Combined DNA/RNA Molecule: Synthetic oligonucleotide
ucuaccaauuccaacuugaauucauug

SEQ ID NO: 2266 - RNA, 27 nt, Artificial Sequence
  Description of Artificial Sequence: Synthetic oligonucleotide
  Description of Combined DNA/RNA Molecule: Synthetic oligonucleotide
uuucuaccaauuccaacuugaauucau

SEQ ID NO: 2267 - RNA, 27 nt, Artificial Sequence
  Description of Artificial Sequence: Synthetic oligonucleotide
  Description of Combined DNA/RNA Molecule: Synthetic oligonucleotide
aaaguuuuucuaccaauuccaacuuga

SEQ ID NO: 2268 - RNA, 27 nt, Artificial Sequence
  Description of Artificial Sequence: Synthetic oligonucleotide
  Description of Combined DNA/RNA Molecule: Synthetic oligonucleotide
cagcaaaaaguuuuucuaccaauucca

SEQ ID NO: 2269 - RNA, 27 nt, Artificial Sequence
  Description of Artificial Sequence: Synthetic oligonucleotide
  Description of Combined DNA/RNA Molecule: Synthetic oligonucleotide
ucagcaaaaaguuuuucuaccaauucc

SEQ ID NO: 2270 - RNA, 27 nt, Artificial Sequence
  Description of Artificial Sequence: Synthetic oligonucleotide
  Description of Combined DNA/RNA Molecule: Synthetic oligonucleotide
gugucuucagcaaaaaguuuuucuacc

SEQ ID NO: 2271 - RNA, 27 nt, Artificial Sequence
  Description of Artificial Sequence: Synthetic oligonucleotide
  Description of Combined DNA/RNA Molecule: Synthetic oligonucleotide
ugugucuucagcaaaaaguuuuucuac

SEQ ID NO: 2272 - RNA, 27 nt, Artificial Sequence
  Description of Artificial Sequence: Synthetic oligonucleotide
  Description of Combined DNA/RNA Molecule: Synthetic oligonucleotide
uugcuucugugucuucagcaaaaaguu

SEQ ID NO: 2273 - RNA, 27 nt, Artificial Sequence
  Description of Artificial Sequence: Synthetic oligonucleotide
  Description of Combined DNA/RNA Molecule: Synthetic oligonucleotide
ggguucuuugcuucugugucuucagca

SEQ ID NO: 2274 - RNA, 27 nt, Artificial Sequence
  Description of Artificial Sequence: Synthetic oligonucleotide
  Description of Combined DNA/RNA Molecule: Synthetic oligonucleotide
uggguucuuugcuucugugucuucagc

SEQ ID NO: 2275 - RNA, 27 nt, Artificial Sequence
  Description of Artificial Sequence: Synthetic oligonucleotide
  Description of Combined DNA/RNA Molecule: Synthetic oligonucleotide
guagaaaauggguucuuugcuucugug

SEQ ID NO: 2276 - RNA, 27 nt, Artificial Sequence
  Description of Artificial Sequence: Synthetic oligonucleotide
  Description of Combined DNA/RNA Molecule: Synthetic oligonucleotide
guguccugaguagaaaauggguucuuu

SEQ ID NO: 2277 - RNA, 27 nt, Artificial Sequence
  Description of Artificial Sequence: Synthetic oligonucleotide
  Description of Combined DNA/RNA Molecule: Synthetic oligonucleotide
ucuccaagucuaaaucuguguccugag

SEQ ID NO: 2278 - RNA, 27 nt, Artificial Sequence
  Description of Artificial Sequence: Synthetic oligonucleotide
  Description of Combined DNA/RNA Molecule: Synthetic oligonucleotide
gcuaacaucuccaagucuaaaucugug

SEQ ID NO: 2279 - RNA, 27 nt, Artificial Sequence
  Description of Artificial Sequence: Synthetic oligonucleotide
  Description of Combined DNA/RNA Molecule: Synthetic oligonucleotide
gagcuaacaucuccaagucuaaaucug

SEQ ID NO: 2280 - RNA, 27 nt, Artificial Sequence
  Description of Artificial Sequence: Synthetic oligonucleotide
  Description of Combined DNA/RNA Molecule: Synthetic oligonucleotide
ggagcuaacaucuccaagucuaaaucu

SEQ ID NO: 2281 - RNA, 27 nt, Artificial Sequence
  Description of Artificial Sequence: Synthetic oligonucleotide
  Description of Combined DNA/RNA Molecule: Synthetic oligonucleotide
ugggauauagggagcuaacaucuccaa

SEQ ID NO: 2282 - RNA, 27 nt, Artificial Sequence
  Description of Artificial Sequence: Synthetic oligonucleotide
  Description of Combined DNA/RNA Molecule: Synthetic oligonucleotide
aaggaacguaacuggaagucaucaucc

SEQ ID NO: 2283 - RNA, 27 nt, Artificial Sequence
  Description of Artificial Sequence: Synthetic oligonucleotide
  Description of Combined DNA/RNA Molecule: Synthetic oligonucleotide
gcuuucuaauggugacaacugaucgaa

SEQ ID NO: 2284 - RNA, 27 nt, Artificial Sequence
  Description of Artificial Sequence: Synthetic oligonucleotide
  Description of Combined DNA/RNA Molecule: Synthetic oligonucleotide
cggaacugcuuucuaauggugacaacu

SEQ ID NO: 2285 - RNA, 27 nt, Artificial Sequence
  Description of Artificial Sequence: Synthetic oligonucleotide
  Description of Combined DNA/RNA Molecule: Synthetic oligonucleotide
ugagucugcuggaauacuguaacugug

SEQ ID NO: 2286 - RNA, 27 nt, Artificial Sequence
  Description of Artificial Sequence: Synthetic oligonucleotide
  Description of Combined DNA/RNA Molecule: Synthetic oligonucleotide
ggucuuuugucacuguuuuuaauucau

SEQ ID NO: 2287 - RNA, 27 nt, Artificial Sequence
  Description of Artificial Sequence: Synthetic oligonucleotide
  Description of Combined DNA/RNA Molecule: Synthetic oligonucleotide
cggucuuuugucacuguuuuuaauuca

SEQ ID NO: 2288 - RNA, 27 nt, Artificial Sequence
  Description of Artificial Sequence: Synthetic oligonucleotide
  Description of Combined DNA/RNA Molecule: Synthetic oligonucleotide
acggucuuuugucacuguuuuuaauuc

SEQ ID NO: 2289 - RNA, 27 nt, Artificial Sequence
  Description of Artificial Sequence: Synthetic oligonucleotide
  Description of Combined DNA/RNA Molecule: Synthetic oligonucleotide
ucuuccauacggucuuuugucacuguu

SEQ ID NO: 2290 - RNA, 27 nt, Artificial Sequence
  Description of Artificial Sequence: Synthetic oligonucleotide
  Description of Combined DNA/RNA Molecule: Synthetic oligonucleotide
ugucuuccauacggucuuuugucacug

SEQ ID NO: 2291 - RNA, 27 nt, Artificial Sequence
  Description of Artificial Sequence: Synthetic oligonucleotide
  Description of Combined DNA/RNA Molecule: Synthetic oligonucleotide
ucaauauuuuaaugucuuccauacggu

SEQ ID NO: 2292 - RNA, 27 nt, Artificial Sequence
  Description of Artificial Sequence: Synthetic oligonucleotide
  Description of Combined DNA/RNA Molecule: Synthetic oligonucleotide
caaucaauauuuuaaugucuuccauac

SEQ ID NO: 2293 - RNA, 27 nt, Artificial Sequence
  Description of Artificial Sequence: Synthetic oligonucleotide
  Description of Combined DNA/RNA Molecule: Synthetic oligonucleotide
gcaaucaauauuuuaaugucuuccaua

SEQ ID NO: 2294 - RNA, 27 nt, Artificial Sequence
  Description of Artificial Sequence: Synthetic oligonucleotide
  Description of Combined DNA/RNA Molecule: Synthetic oligonucleotide
augcaaucaauauuuuaaugucuucca

SEQ ID NO: 2295 - RNA, 27 nt, Artificial Sequence
  Description of Artificial Sequence: Synthetic oligonucleotide
  Description of Combined DNA/RNA Molecule: Synthetic oligonucleotide
gcuguccgacuuugaguaucucuauau

SEQ ID NO: 2296 - RNA, 27 nt, Artificial Sequence
  Description of Artificial Sequence: Synthetic oligonucleotide
  Description of Combined DNA/RNA Molecule: Synthetic oligonucleotide
ucugucuguucuaugacuccuuuuccu

SEQ ID NO: 2297 - RNA, 27 nt, Artificial Sequence
  Description of Artificial Sequence: Synthetic oligonucleotide
  Description of Combined DNA/RNA Molecule: Synthetic oligonucleotide
uuuuucugucuguucuaugacuccuuu

SEQ ID NO: 2298 - RNA, 27 nt, Artificial Sequence
  Description of Artificial Sequence: Synthetic oligonucleotide
  Description of Combined DNA/RNA Molecule: Synthetic oligonucleotide
auuuuucugucuguucuaugacuccuu

SEQ ID NO: 2299 - RNA, 27 nt, Artificial Sequence
  Description of Artificial Sequence: Synthetic oligonucleotide
  Description of Combined DNA/RNA Molecule: Synthetic oligonucleotide
gggcuucuuggaugagauuuuucuguc

SEQ ID NO: 2300 - RNA, 27 nt, Artificial Sequence
  Description of Artificial Sequence: Synthetic oligonucleotide
  Description of Combined DNA/RNA Molecule: Synthetic oligonucleotide
agggcuucuuggaugagauuuuucugu

SEQ ID NO: 2301 - RNA, 27 nt, Artificial Sequence
  Description of Artificial Sequence: Synthetic oligonucleotide
  Description of Combined DNA/RNA Molecule: Synthetic oligonucleotide
uugacucaaagcgacagauaacacguu

SEQ ID NO: 2302 - RNA, 27 nt, Artificial Sequence
  Description of Artificial Sequence: Synthetic oligonucleotide
  Description of Combined DNA/RNA Molecule: Synthetic oligonucleotide
uuugacucaaagcgacagauaacacgu

SEQ ID NO: 2303 - RNA, 27 nt, Artificial Sequence
  Description of Artificial Sequence: Synthetic oligonucleotide
  Description of Combined DNA/RNA Molecule: Synthetic oligonucleotide
guaguucuuugacucaaagcgacagau

SEQ ID NO: 2304 - RNA, 27 nt, Artificial Sequence
  Description of Artificial Sequence: Synthetic oligonucleotide
  Description of Combined DNA/RNA Molecule: Synthetic oligonucleotide
aggaacuguaguucuuugacucaaagc

SEQ ID NO: 2305 - RNA, 27 nt, Artificial Sequence
  Description of Artificial Sequence: Synthetic oligonucleotide
  Description of Combined DNA/RNA Molecule: Synthetic oligonucleotide
caggaacuguaguucuuugacucaaag

SEQ ID NO: 2306 - RNA, 27 nt, Artificial Sequence
  Description of Artificial Sequence: Synthetic oligonucleotide
  Description of Combined DNA/RNA Molecule: Synthetic oligonucleotide
cuuccucaggaacuguaguucuuugac

SEQ ID NO: 2307 - RNA, 27 nt, Artificial Sequence
  Description of Artificial Sequence: Synthetic oligonucleotide
  Description of Combined DNA/RNA Molecule: Synthetic oligonucleotide
ucuuccucaggaacuguaguucuuuga

SEQ ID NO: 2308 - RNA, 27 nt, Artificial Sequence
  Description of Artificial Sequence: Synthetic oligonucleotide
  Description of Combined DNA/RNA Molecule: Synthetic oligonucleotide
guaucuuuggauuuaguucuuccucag

SEQ ID NO: 2309 - RNA, 27 nt, Artificial Sequence
  Description of Artificial Sequence: Synthetic oligonucleotide
  Description of Combined DNA/RNA Molecule: Synthetic oligonucleotide
aguaucuuuggauuuaguucuuccuca

SEQ ID NO: 2310 - RNA, 27 nt, Artificial Sequence
  Description of Artificial Sequence: Synthetic oligonucleotide
  Description of Combined DNA/RNA Molecule: Synthetic oligonucleotide
uaguaucuuuggauuuaguucuuccuc

SEQ ID NO: 2311 - RNA, 27 nt, Artificial Sequence
  Description of Artificial Sequence: Synthetic oligonucleotide
  Description of Combined DNA/RNA Molecule: Synthetic oligonucleotide
cuaguaucuuuggauuuaguucuuccu

SEQ ID NO: 2312 - RNA, 27 nt, Artificial Sequence
  Description of Artificial Sequence: Synthetic oligonucleotide
  Description of Combined DNA/RNA Molecule: Synthetic oligonucleotide
cugcaaagcuaguaucuuuggauuuag

SEQ ID NO: 2313 - RNA, 27 nt, Artificial Sequence
  Description of Artificial Sequence: Synthetic oligonucleotide
  Description of Combined DNA/RNA Molecule: Synthetic oligonucleotide
gcauucugcaaagcuaguaucuuugga

SEQ ID NO: 2314 - RNA, 27 nt, Artificial Sequence
  Description of Artificial Sequence: Synthetic oligonucleotide
  Description of Combined DNA/RNA Molecule: Synthetic oligonucleotide
gagcauucugcaaagcuaguaucuuug

SEQ ID NO: 2315 - RNA, 27 nt, Artificial Sequence
  Description of Artificial Sequence: Synthetic oligonucleotide
  Description of Combined DNA/RNA Molecule: Synthetic oligonucleotide
ugagcauucugcaaagcuaguaucuuu

SEQ ID NO: 2316 - RNA, 27 nt, Artificial Sequence
  Description of Artificial Sequence: Synthetic oligonucleotide
  Description of Combined DNA/RNA Molecule: Synthetic oligonucleotide
ccaucauguuccauuuuucgcuuucuc

SEQ ID NO: 2317 - RNA, 27 nt, Artificial Sequence
  Description of Artificial Sequence: Synthetic oligonucleotide
  Description of Combined DNA/RNA Molecule: Synthetic oligonucleotide
ugaaaaagugaaccaucauguuccauu

SEQ ID NO: 2318 - RNA, 27 nt, Artificial Sequence
  Description of Artificial Sequence: Synthetic oligonucleotide
  Description of Combined DNA/RNA Molecule: Synthetic oligonucleotide
acugcuugaaaaagugaaccaucaugu

SEQ ID NO: 2319 - RNA, 27 nt, Artificial Sequence
  Description of Artificial Sequence: Synthetic oligonucleotide
  Description of Combined DNA/RNA Molecule: Synthetic oligonucleotide
guuccaauuccuacugcuugaaaaagu

SEQ ID NO: 2320 - RNA, 27 nt, Artificial Sequence
  Description of Artificial Sequence: Synthetic oligonucleotide
  Description of Combined DNA/RNA Molecule: Synthetic oligonucleotide
uguaauaauguuccaauuccuacugcu

SEQ ID NO: 2321 - RNA, 27 nt, Artificial Sequence
  Description of Artificial Sequence: Synthetic oligonucleotide
  Description of Combined DNA/RNA Molecule: Synthetic oligonucleotide
cuguaauaauguuccaauuccuacugc

SEQ ID NO: 2322 - RNA, 27 nt, Artificial Sequence
  Description of Artificial Sequence: Synthetic oligonucleotide
  Description of Combined DNA/RNA Molecule: Synthetic oligonucleotide
gcuguaauaauguuccaauuccuacug

SEQ ID NO: 2323 - RNA, 27 nt, Artificial Sequence
  Description of Artificial Sequence: Synthetic oligonucleotide
  Description of Combined DNA/RNA Molecule: Synthetic oligonucleotide
uugcauccuuuuacacguuuccaagaa

SEQ ID NO: 2324 - RNA, 27 nt, Artificial Sequence
  Description of Artificial Sequence: Synthetic oligonucleotide
  Description of Combined DNA/RNA Molecule: Synthetic oligonucleotide
uuugcauccuuuuacacguuuccaaga

SEQ ID NO: 2325 - RNA, 27 nt, Artificial Sequence
  Description of Artificial Sequence: Synthetic oligonucleotide
  Description of Combined DNA/RNA Molecule: Synthetic oligonucleotide
uguucacuagauuugcauccuuuuaca

SEQ ID NO: 2326 - RNA, 27 nt, Artificial Sequence
  Description of Artificial Sequence: Synthetic oligonucleotide
  Description of Combined DNA/RNA Molecule: Synthetic oligonucleotide
cuguucacuagauuugcauccuuuuac

SEQ ID NO: 2327 - RNA, 27 nt, Artificial Sequence
  Description of Artificial Sequence: Synthetic oligonucleotide
  Description of Combined DNA/RNA Molecule: Synthetic oligonucleotide
ccauucuguucacuagauuugcauccu

SEQ ID NO: 2328 - RNA, 27 nt, Artificial Sequence
  Description of Artificial Sequence: Synthetic oligonucleotide
  Description of Combined DNA/RNA Molecule: Synthetic oligonucleotide
cauuccauucuguucacuagauuugca

SEQ ID NO: 2329 - RNA, 27 nt, Artificial Sequence
  Description of Artificial Sequence: Synthetic oligonucleotide
  Description of Combined DNA/RNA Molecule: Synthetic oligonucleotide
uugcuccauuccauucuguucacuaga

SEQ ID NO: 2330 - RNA, 27 nt, Artificial Sequence
  Description of Artificial Sequence: Synthetic oligonucleotide
  Description of Combined DNA/RNA Molecule: Synthetic oligonucleotide
uuugcuccauuccauucuguucacuag

SEQ ID NO: 2331 - RNA, 27 nt, Artificial Sequence
  Description of Artificial Sequence: Synthetic oligonucleotide
  Description of Combined DNA/RNA Molecule: Synthetic oligonucleotide
auugucuuuugcuccauuccauucugu

SEQ ID NO: 2332 - RNA, 27 nt, Artificial Sequence
  Description of Artificial Sequence: Synthetic oligonucleotide
  Description of Combined DNA/RNA Molecule: Synthetic oligonucleotide
aaauaauugucuuuugcuccauuccau

SEQ ID NO: 2333 - RNA, 27 nt, Artificial Sequence
  Description of Artificial Sequence: Synthetic oligonucleotide
  Description of Combined DNA/RNA Molecule: Synthetic oligonucleotide
uaaaauaauugucuuuugcuccauucc

SEQ ID NO: 2334 - RNA, 27 nt, Artificial Sequence
  Description of Artificial Sequence: Synthetic oligonucleotide
  Description of Combined DNA/RNA Molecule: Synthetic oligonucleotide
uuaaaauaauugucuuuugcuccauuc

SEQ ID NO: 2335 - RNA, 27 nt, Artificial Sequence
  Description of Artificial Sequence: Synthetic oligonucleotide
  Description of Combined DNA/RNA Molecule: Synthetic oligonucleotide
auuaaaauaauugucuuuugcuccauu

SEQ ID NO: 2336 - RNA, 27 nt, Artificial Sequence
  Description of Artificial Sequence: Synthetic oligonucleotide
  Description of Combined DNA/RNA Molecule: Synthetic oligonucleotide
uauuaaaauaauugucuuuugcuccau

SEQ ID NO: 2337 - RNA, 27 nt, Artificial Sequence
  Description of Artificial Sequence: Synthetic oligonucleotide
  Description of Combined DNA/RNA Molecule: Synthetic oligonucleotide
uaaaucagaggguauuaaaauaauugu

SEQ ID NO: 2338 - RNA, 27 nt, Artificial Sequence
  Description of Artificial Sequence: Synthetic oligonucleotide
  Description of Combined DNA/RNA Molecule: Synthetic oligonucleotide
cuaaaucagaggguauuaaaauaauug

SEQ ID NO: 2339 - RNA, 27 nt, Artificial Sequence
  Description of Artificial Sequence: Synthetic oligonucleotide
  Description of Combined DNA/RNA Molecule: Synthetic oligonucleotide
gcuaaaucagaggguauuaaaauaauu

SEQ ID NO: 2340 - RNA, 27 nt, Artificial Sequence
  Description of Artificial Sequence: Synthetic oligonucleotide
  Description of Combined DNA/RNA Molecule: Synthetic oligonucleotide
augcuaaaucagaggguauuaaaauaa

SEQ ID NO: 2341 - RNA, 27 nt, Artificial Sequence
  Description of Artificial Sequence: Synthetic oligonucleotide
  Description of Combined DNA/RNA Molecule: Synthetic oligonucleotide
caugcuaaaucagaggguauuaaaaua

SEQ ID NO: 2342 - RNA, 27 nt, Artificial Sequence
  Description of Artificial Sequence: Synthetic oligonucleotide
  Description of Combined DNA/RNA Molecule: Synthetic oligonucleotide
ccacuuucauccauugauugccccagc

SEQ ID NO: 2343 - RNA, 27 nt, Artificial Sequence
  Description of Artificial Sequence: Synthetic oligonucleotide
  Description of Combined DNA/RNA Molecule: Synthetic oligonucleotide
guaauccacuuucauccauugauugcc

SEQ ID NO: 2344 - RNA, 27 nt, Artificial Sequence
  Description of Artificial Sequence: Synthetic oligonucleotide
  Description of Combined DNA/RNA Molecule: Synthetic oligonucleotide
gagcauuaacuucacaaucauaacugg

SEQ ID NO: 2345 - RNA, 27 nt, Artificial Sequence
  Description of Artificial Sequence: Synthetic oligonucleotide
  Description of Combined DNA/RNA Molecule: Synthetic oligonucleotide
ggagcauuaacuucacaaucauaacug

SEQ ID NO: 2346 - RNA, 27 nt, Artificial Sequence
  Description of Artificial Sequence: Synthetic oligonucleotide
  Description of Combined DNA/RNA Molecule: Synthetic oligonucleotide
cuuguauaggagcauuaacuucacaau

SEQ ID NO: 2347 - RNA, 27 nt, Artificial Sequence
  Description of Artificial Sequence: Synthetic oligonucleotide
  Description of Combined DNA/RNA Molecule: Synthetic oligonucleotide
cugccuuguauaggagcauuaacuuca

SEQ ID NO: 2348 - RNA, 27 nt, Artificial Sequence
  Description of Artificial Sequence: Synthetic oligonucleotide
  Description of Combined DNA/RNA Molecule: Synthetic oligonucleotide
aaagcucugaguaauucuucacccugc

SEQ ID NO: 2349 - RNA, 27 nt, Artificial Sequence
  Description of Artificial Sequence: Synthetic oligonucleotide
  Description of Combined DNA/RNA Molecule: Synthetic oligonucleotide
ugauccaaagcucugaguaauucuuca

SEQ ID NO: 2350 - RNA, 27 nt, Artificial Sequence
  Description of Artificial Sequence: Synthetic oligonucleotide
  Description of Combined DNA/RNA Molecule: Synthetic oligonucleotide
cuugauccaaagcucugaguaauucuu

SEQ ID NO: 2351 - RNA, 27 nt, Artificial Sequence
  Description of Artificial Sequence: Synthetic oligonucleotide
  Description of Combined DNA/RNA Molecule: Synthetic oligonucleotide
ucaguuaacuugauccaaagcucugag

SEQ ID NO: 2352 - RNA, 27 nt, Artificial Sequence
  Description of Artificial Sequence: Synthetic oligonucleotide
  Description of Combined DNA/RNA Molecule: Synthetic oligonucleotide
aaauuaagaaaaagcucaguuaacuug

SEQ ID NO: 2353 - RNA, 27 nt, Artificial Sequence
  Description of Artificial Sequence: Synthetic oligonucleotide
  Description of Combined DNA/RNA Molecule: Synthetic oligonucleotide
ugaaauuaagaaaaagcucaguuaacu

SEQ ID NO: 2354 - RNA, 27 nt, Artificial Sequence
  Description of Artificial Sequence: Synthetic oligonucleotide
  Description of Combined DNA/RNA Molecule: Synthetic oligonucleotide
aaaaaaaggaaugaaauuaagaaaaag

SEQ ID NO: 2355 - RNA, 27 nt, Artificial Sequence
  Description of Artificial Sequence: Synthetic oligonucleotide
  Description of Combined DNA/RNA Molecule: Synthetic oligonucleotide
uguccaaaaaaaggaaugaaauuaaga

SEQ ID NO: 2356 - RNA, 27 nt, Artificial Sequence
  Description of Artificial Sequence: Synthetic oligonucleotide
  Description of Combined DNA/RNA Molecule: Synthetic oligonucleotide
aguguccaaaaaaaggaaugaaauuaa

SEQ ID NO: 2357 - RNA, 27 nt, Artificial Sequence
  Description of Artificial Sequence: Synthetic oligonucleotide
  Description of Combined DNA/RNA Molecule: Synthetic oligonucleotide
acugcuuuagguaaugagccaccagug

SEQ ID NO: 2358 - RNA, 27 nt, Artificial Sequence
  Description of Artificial Sequence: Synthetic oligonucleotide
  Description of Combined DNA/RNA Molecule: Synthetic oligonucleotide
uauaaauagacugcuuuagguaaugag

SEQ ID NO: 2359 - RNA, 27 nt, Artificial Sequence
  Description of Artificial Sequence: Synthetic oligonucleotide
  Description of Combined DNA/RNA Molecule: Synthetic oligonucleotide
auauaaauagacugcuuuagguaauga

SEQ ID NO: 2360 - RNA, 27 nt, Artificial Sequence
  Description of Artificial Sequence: Synthetic oligonucleotide
  Description of Combined DNA/RNA Molecule: Synthetic oligonucleotide
agaaaauauaaauagacugcuuuaggu

SEQ ID NO: 2361 - RNA, 27 nt, Artificial Sequence
  Description of Artificial Sequence: Synthetic oligonucleotide
  Description of Combined DNA/RNA Molecule: Synthetic oligonucleotide
guagaaaauauaaauagacugcuuuag

SEQ ID NO: 2362 - RNA, 27 nt, Artificial Sequence
  Description of Artificial Sequence: Synthetic oligonucleotide
  Description of Combined DNA/RNA Molecule: Synthetic oligonucleotide
uaaaauuagauguagaaaauauaaaua

SEQ ID NO: 2363 - RNA, 27 nt, Artificial Sequence
  Description of Artificial Sequence: Synthetic oligonucleotide
  Description of Combined DNA/RNA Molecule: Synthetic oligonucleotide
cuaaaauuagauguagaaaauauaaau

SEQ ID NO: 2364 - RNA, 27 nt, Artificial Sequence
  Description of Artificial Sequence: Synthetic oligonucleotide
  Description of Combined DNA/RNA Molecule: Synthetic oligonucleotide
ucuaaaauuagauguagaaaauauaaa

SEQ ID NO: 2365 - RNA, 27 nt, Artificial Sequence
  Description of Artificial Sequence: Synthetic oligonucleotide
  Description of Combined DNA/RNA Molecule: Synthetic oligonucleotide
cuucuaaaauuagauguagaaaauaua

SEQ ID NO: 2366 - RNA, 27 nt, Artificial Sequence
  Description of Artificial Sequence: Synthetic oligonucleotide
  Description of Combined DNA/RNA Molecule: Synthetic oligonucleotide
gcuucuaaaauuagauguagaaaauau

SEQ ID NO: 2367 - RNA, 27 nt, Artificial Sequence
  Description of Artificial Sequence: Synthetic oligonucleotide
  Description of Combined DNA/RNA Molecule: Synthetic oligonucleotide
caaguuugugcaguauuguagccaggc

SEQ ID NO: 2368 - RNA, 27 nt, Artificial Sequence
  Description of Artificial Sequence: Synthetic oligonucleotide
  Description of Combined DNA/RNA Molecule: Synthetic oligonucleotide
ggggaucaaaauugaacuaaccaaguu

SEQ ID NO: 2369 - RNA, 27 nt, Artificial Sequence
  Description of Artificial Sequence: Synthetic oligonucleotide
  Description of Combined DNA/RNA Molecule: Synthetic oligonucleotide
guagaaaggggaucaaaauugaacuaa

SEQ ID NO: 2370 - RNA, 27 nt, Artificial Sequence
  Description of Artificial Sequence: Synthetic oligonucleotide
  Description of Combined DNA/RNA Molecule: Synthetic oligonucleotide
uaaauuaaguagaaaggggaucaaaau

SEQ ID NO: 2371 - RNA, 27 nt, Artificial Sequence
  Description of Artificial Sequence: Synthetic oligonucleotide
  Description of Combined DNA/RNA Molecule: Synthetic oligonucleotide
guaaauuaaguagaaaggggaucaaaa

SEQ ID NO: 2372 - RNA, 27 nt, Artificial Sequence
  Description of Artificial Sequence: Synthetic oligonucleotide
  Description of Combined DNA/RNA Molecule: Synthetic oligonucleotide
uguaaauuaaguagaaaggggaucaaa

SEQ ID NO: 2373 - RNA, 27 nt, Artificial Sequence
  Description of Artificial Sequence: Synthetic oligonucleotide
  Description of Combined DNA/RNA Molecule: Synthetic oligonucleotide
gcauuaauguaaauuaaguagaaaggg

SEQ ID NO: 2374 - RNA, 27 nt, Artificial Sequence
  Description of Artificial Sequence: Synthetic oligonucleotide
  Description of Combined DNA/RNA Molecule: Synthetic oligonucleotide
cuaaaaaagagcauuaauguaaauuaa

SEQ ID NO: 2375 - RNA, 27 nt, Artificial Sequence
  Description of Artificial Sequence: Synthetic oligonucleotide
  Description of Combined DNA/RNA Molecule: Synthetic oligonucleotide
acuaaaaaagagcauuaauguaaauua

SEQ ID NO: 2376 - RNA, 27 nt, Artificial Sequence
  Description of Artificial Sequence: Synthetic oligonucleotide
  Description of Combined DNA/RNA Molecule: Synthetic oligonucleotide
gaacauacuaaaaaagagcauuaaugu

SEQ ID NO: 2377 - RNA, 27 nt, Artificial Sequence
  Description of Artificial Sequence: Synthetic oligonucleotide
  Description of Combined DNA/RNA Molecule: Synthetic oligonucleotide
agaacauacuaaaaaagagcauuaaug

SEQ ID NO: 2378 - RNA, 27 nt, Artificial Sequence
  Description of Artificial Sequence: Synthetic oligonucleotide
  Description of Combined DNA/RNA Molecule: Synthetic oligonucleotide
aaagaacauacuaaaaaagagcauuaa

SEQ ID NO: 2379 - RNA, 27 nt, Artificial Sequence
  Description of Artificial Sequence: Synthetic oligonucleotide
  Description of Combined DNA/RNA Molecule: Synthetic oligonucleotide
ccagcauuaaagaacauacuaaaaaag

SEQ ID NO: 2380 - RNA, 27 nt, Artificial Sequence
  Description of Artificial Sequence: Synthetic oligonucleotide
  Description of Combined DNA/RNA Molecule: Synthetic oligonucleotide
ugauccagcauuaaagaacauacuaaa

SEQ ID NO: 2381 - RNA, 27 nt, Artificial Sequence
  Description of Artificial Sequence: Synthetic oligonucleotide
  Description of Combined DNA/RNA Molecule: Synthetic oligonucleotide
gugauccagcauuaaagaacauacuaa

SEQ ID NO: 2382 - RNA, 27 nt, Artificial Sequence
  Description of Artificial Sequence: Synthetic oligonucleotide
  Description of Combined DNA/RNA Molecule: Synthetic oligonucleotide
ugugauccagcauuaaagaacauacua

SEQ ID NO: 2383 - RNA, 27 nt, Artificial Sequence
  Description of Artificial Sequence: Synthetic oligonucleotide
  Description of Combined DNA/RNA Molecule: Synthetic oligonucleotide
aaaaacugagaaaaugagcugucugug

SEQ ID NO: 2384 - RNA, 27 nt, Artificial Sequence
  Description of Artificial Sequence: Synthetic oligonucleotide
  Description of Combined DNA/RNA Molecule: Synthetic oligonucleotide
uaaauaccaaaaaacugagaaaaugag

SEQ ID NO: 2385 - RNA, 27 nt, Artificial Sequence
  Description of Artificial Sequence: Synthetic oligonucleotide
  Description of Combined DNA/RNA Molecule: Synthetic oligonucleotide
uuaaauaccaaaaaacugagaaaauga

SEQ ID NO: 2386 - RNA, 27 nt, Artificial Sequence
  Description of Artificial Sequence: Synthetic oligonucleotide
  Description of Combined DNA/RNA Molecule: Synthetic oligonucleotide
uuuaaauaccaaaaaacugagaaaaug

SEQ ID NO: 2387 - RNA, 27 nt, Artificial Sequence
  Description of Artificial Sequence: Synthetic oligonucleotide
  Description of Combined DNA/RNA Molecule: Synthetic oligonucleotide
aaugcaaugguuuaaauaccaaaaaac

SEQ ID NO: 2388 - RNA, 27 nt, Artificial Sequence
  Description of Artificial Sequence: Synthetic oligonucleotide
  Description of Combined DNA/RNA Molecule: Synthetic oligonucleotide
cugcaaugcaaugguuuaaauaccaaa

SEQ ID NO: 2389 - RNA, 27 nt, Artificial Sequence
  Description of Artificial Sequence: Synthetic oligonucleotide
  Description of Combined DNA/RNA Molecule: Synthetic oligonucleotide
acugcaaugcaaugguuuaaauaccaa

SEQ ID NO: 2390 - RNA, 27 nt, Artificial Sequence
  Description of Artificial Sequence: Synthetic oligonucleotide
  Description of Combined DNA/RNA Molecule: Synthetic oligonucleotide
augcuacugcaaugcaaugguuuaaau

SEQ ID NO: 2391 - RNA, 27 nt, Artificial Sequence
  Description of Artificial Sequence: Synthetic oligonucleotide
  Description of Combined DNA/RNA Molecule: Synthetic oligonucleotide
uuuuuuaaaaugaugcuacugcaaugc

SEQ ID NO: 2392 - RNA, 27 nt, Artificial Sequence
  Description of Artificial Sequence: Synthetic oligonucleotide
  Description of Combined DNA/RNA Molecule: Synthetic oligonucleotide
gugcauuuuuuaaaaugaugcuacugc

SEQ ID NO: 2393 - RNA, 27 nt, Artificial Sequence
  Description of Artificial Sequence: Synthetic oligonucleotide
  Description of Combined DNA/RNA Molecule: Synthetic oligonucleotide
ggugcauuuuuuaaaaugaugcuacug

SEQ ID NO: 2394 - RNA, 27 nt, Artificial Sequence
  Description of Artificial Sequence: Synthetic oligonucleotide
  Description of Combined DNA/RNA Molecule: Synthetic oligonucleotide
auaaaaaggugcauuuuuuaaaaugau

SEQ ID NO: 2395 - RNA, 27 nt, Artificial Sequence
  Description of Artificial Sequence: Synthetic oligonucleotide
  Description of Combined DNA/RNA Molecule: Synthetic oligonucleotide
aauaaaaaggugcauuuuuuaaaauga

SEQ ID NO: 2396 - RNA, 27 nt, Artificial Sequence
  Description of Artificial Sequence: Synthetic oligonucleotide
  Description of Combined DNA/RNA Molecule: Synthetic oligonucleotide
aaauaaaaaggugcauuuuuuaaaaug

SEQ ID NO: 2397 - RNA, 27 nt, Artificial Sequence
  Description of Artificial Sequence: Synthetic oligonucleotide
  Description of Combined DNA/RNA Molecule: Synthetic oligonucleotide
uaaauaaaaaggugcauuuuuuaaaau

SEQ ID NO: 2398 - RNA, 27 nt, Artificial Sequence
  Description of Artificial Sequence: Synthetic oligonucleotide
  Description of Combined DNA/RNA Molecule: Synthetic oligonucleotide
auaaauaaaaaggugcauuuuuuaaaa

SEQ ID NO: 2399 - RNA, 27 nt, Artificial Sequence
  Description of Artificial Sequence: Synthetic oligonucleotide
  Description of Combined DNA/RNA Molecule: Synthetic oligonucleotide
aauaaauaaaaaggugcauuuuuuaaa

SEQ ID NO: 2400 - RNA, 27 nt, Artificial Sequence
  Description of Artificial Sequence: Synthetic oligonucleotide
  Description of Combined DNA/RNA Molecule: Synthetic oligonucleotide
uaaauaaauaaaaaggugcauuuuuua

SEQ ID NO: 2401 - RNA, 27 nt, Artificial Sequence
  Description of Artificial Sequence: Synthetic oligonucleotide
  Description of Combined DNA/RNA Molecule: Synthetic oligonucleotide
aauaaauaaauaaaaaggugcauuuuu

SEQ ID NO: 2402 - RNA, 27 nt, Artificial Sequence
  Description of Artificial Sequence: Synthetic oligonucleotide
  Description of Combined DNA/RNA Molecule: Synthetic oligonucleotide
uagccaaaaauaaauaaauaaaaaggu

SEQ ID NO: 2403 - RNA, 27 nt, Artificial Sequence
  Description of Artificial Sequence: Synthetic oligonucleotide
  Description of Combined DNA/RNA Molecule: Synthetic oligonucleotide
acucccuagccaaaaauaaauaaauaa

SEQ ID NO: 2404 - RNA, 27 nt, Artificial Sequence
  Description of Artificial Sequence: Synthetic oligonucleotide
  Description of Combined DNA/RNA Molecule: Synthetic oligonucleotide
aaacucccuagccaaaaauaaauaaau

SEQ ID NO: 2405 - RNA, 27 nt, Artificial Sequence
  Description of Artificial Sequence: Synthetic oligonucleotide
  Description of Combined DNA/RNA Molecule: Synthetic oligonucleotide
uaaacucccuagccaaaaauaaauaaa

SEQ ID NO: 2406 - RNA, 27 nt, Artificial Sequence
  Description of Artificial Sequence: Synthetic oligonucleotide
  Description of Combined DNA/RNA Molecule: Synthetic oligonucleotide
auaaacucccuagccaaaaauaaauaa

SEQ ID NO: 2407 - RNA, 27 nt, Artificial Sequence
  Description of Artificial Sequence: Synthetic oligonucleotide
  Description of Combined DNA/RNA Molecule: Synthetic oligonucleotide
gauaaacucccuagccaaaaauaaaua

SEQ ID NO: 2408 - RNA, 27 nt, Artificial Sequence
  Description of Artificial Sequence: Synthetic oligonucleotide
  Description of Combined DNA/RNA Molecule: Synthetic oligonucleotide
auaauucgaaaaagggauaaacucccu

SEQ ID NO: 2409 - RNA, 27 nt, Artificial Sequence
  Description of Artificial Sequence: Synthetic oligonucleotide
  Description of Combined DNA/RNA Molecule: Synthetic oligonucleotide
aauaauucgaaaaagggauaaacuccc

SEQ ID NO: 2410 - RNA, 27 nt, Artificial Sequence
  Description of Artificial Sequence: Synthetic oligonucleotide
  Description of Combined DNA/RNA Molecule: Synthetic oligonucleotide
aaauaauucgaaaaagggauaaacucc

SEQ ID NO: 2411 - RNA, 27 nt, Artificial Sequence
  Description of Artificial Sequence: Synthetic oligonucleotide
  Description of Combined DNA/RNA Molecule: Synthetic oligonucleotide
aaaauaauucgaaaaagggauaaacuc

SEQ ID NO: 2412 - RNA, 27 nt, Artificial Sequence
  Description of Artificial Sequence: Synthetic oligonucleotide
  Description of Combined DNA/RNA Molecule: Synthetic oligonucleotide
aaaaauaauucgaaaaagggauaaacu

SEQ ID NO: 2413 - RNA, 27 nt, Artificial Sequence
  Description of Artificial Sequence: Synthetic oligonucleotide
  Description of Combined DNA/RNA Molecule: Synthetic oligonucleotide
uaaaaauaauucgaaaaagggauaaac

SEQ ID NO: 2414 - RNA, 27 nt, Artificial Sequence
  Description of Artificial Sequence: Synthetic oligonucleotide
  Description of Combined DNA/RNA Molecule: Synthetic oligonucleotide
uuggcaucuucuuaaaaauaauucgaa

SEQ ID NO: 2415 - RNA, 27 nt, Artificial Sequence
  Description of Artificial Sequence: Synthetic oligonucleotide
  Description of Combined DNA/RNA Molecule: Synthetic oligonucleotide
uuauauuggcaucuucuuaaaaauaau

SEQ ID NO: 2416 - RNA, 27 nt, Artificial Sequence
  Description of Artificial Sequence: Synthetic oligonucleotide
  Description of Combined DNA/RNA Molecule: Synthetic oligonucleotide
auuauauuggcaucuucuuaaaaauaa

SEQ ID NO: 2417 - RNA, 27 nt, Artificial Sequence
  Description of Artificial Sequence: Synthetic oligonucleotide
  Description of Combined DNA/RNA Molecule: Synthetic oligonucleotide
aaauuauauuggcaucuucuuaaaaau

SEQ ID NO: 2418 - RNA, 27 nt, Artificial Sequence
  Description of Artificial Sequence: Synthetic oligonucleotide
  Description of Combined DNA/RNA Molecule: Synthetic oligonucleotide
aaaauuauauuggcaucuucuuaaaaa

SEQ ID NO: 2419 - RNA, 27 nt, Artificial Sequence
  Description of Artificial Sequence: Synthetic oligonucleotide
  Description of Combined DNA/RNA Molecule: Synthetic oligonucleotide
caaaaauuauauuggcaucuucuuaaa

SEQ ID NO: 2420 - RNA, 27 nt, Artificial Sequence
  Description of Artificial Sequence: Synthetic oligonucleotide
  Description of Combined DNA/RNA Molecule: Synthetic oligonucleotide
acaaaaauuauauuggcaucuucuuaa

SEQ ID NO: 2421 - RNA, 27 nt, Artificial Sequence
  Description of Artificial Sequence: Synthetic oligonucleotide
  Description of Combined DNA/RNA Molecule: Synthetic oligonucleotide
uuacaaaaauuauauuggcaucuucuu

SEQ ID NO: 2422 - RNA, 27 nt, Artificial Sequence
  Description of Artificial Sequence: Synthetic oligonucleotide
  Description of Combined DNA/RNA Molecule: Synthetic oligonucleotide
cuuacaaaaauuauauuggcaucuucu

SEQ ID NO: 2423 - RNA, 27 nt, Artificial Sequence
  Description of Artificial Sequence: Synthetic oligonucleotide
  Description of Combined DNA/RNA Molecule: Synthetic oligonucleotide
ucuuacaaaaauuauauuggcaucuuc

SEQ ID NO: 2424 - RNA, 27 nt, Artificial Sequence
  Description of Artificial Sequence: Synthetic oligonucleotide
  Description of Combined DNA/RNA Molecule: Synthetic oligonucleotide
acugccuucuuacaaaaauuauauugg

SEQ ID NO: 2425 - RNA, 27 nt, Artificial Sequence
  Description of Artificial Sequence: Synthetic oligonucleotide
  Description of Combined DNA/RNA Molecule: Synthetic oligonucleotide
gguuacugccuucuuacaaaaauuaua

SEQ ID NO: 2426 - RNA, 27 nt, Artificial Sequence
  Description of Artificial Sequence: Synthetic oligonucleotide
  Description of Combined DNA/RNA Molecule: Synthetic oligonucleotide
aagguuacugccuucuuacaaaaauua

SEQ ID NO: 2427 - RNA, 27 nt, Artificial Sequence
  Description of Artificial Sequence: Synthetic oligonucleotide
  Description of Combined DNA/RNA Molecule: Synthetic oligonucleotide
aauuuuucaacugccuaugaucaugau

SEQ ID NO: 2428 - RNA, 27 nt, Artificial Sequence
  Description of Artificial Sequence: Synthetic oligonucleotide
  Description of Combined DNA/RNA Molecule: Synthetic oligonucleotide
aaaauuuuucaacugccuaugaucaug

SEQ ID NO: 2429 - RNA, 27 nt, Artificial Sequence
  Description of Artificial Sequence: Synthetic oligonucleotide
  Description of Combined DNA/RNA Molecule: Synthetic oligonucleotide
uguaaaaauuuuucaacugccuaugau

SEQ ID NO: 2430 - RNA, 27 nt, Artificial Sequence
  Description of Artificial Sequence: Synthetic oligonucleotide
  Description of Combined DNA/RNA Molecule: Synthetic oligonucleotide
gguguaaaaauuuuucaacugccuaug

SEQ ID NO: 2431 - RNA, 27 nt, Artificial Sequence
  Description of Artificial Sequence: Synthetic oligonucleotide
  Description of Combined DNA/RNA Molecule: Synthetic oligonucleotide
aaaaaaaagguguaaaaauuuuucaac

SEQ ID NO: 2432 - RNA, 27 nt, Artificial Sequence
  Description of Artificial Sequence: Synthetic oligonucleotide
  Description of Combined DNA/RNA Molecule: Synthetic oligonucleotide
gaaaaaaaagguguaaaaauuuuucaa

SEQ ID NO: 2433 - RNA, 27 nt, Artificial Sequence
  Description of Artificial Sequence: Synthetic oligonucleotide
  Description of Combined DNA/RNA Molecule: Synthetic oligonucleotide
ugaaaaaaaagguguaaaaauuuuuca

SEQ ID NO: 2434 - RNA, 27 nt, Artificial Sequence
  Description of Artificial Sequence: Synthetic oligonucleotide
  Description of Combined DNA/RNA Molecule: Synthetic oligonucleotide
gugaaaaaaaagguguaaaaauuuuuc

SEQ ID NO: 2435 - RNA, 27 nt, Artificial Sequence
  Description of Artificial Sequence: Synthetic oligonucleotide
  Description of Combined DNA/RNA Molecule: Synthetic oligonucleotide
ugugaaaaaaaagguguaaaaauuuuu

SEQ ID NO: 2436 - RNA, 27 nt, Artificial Sequence
  Description of Artificial Sequence: Synthetic oligonucleotide
  Description of Combined DNA/RNA Molecule: Synthetic oligonucleotide
uuauuuauguaaaaugugaaaaaaaag

SEQ ID NO: 2437 - RNA, 27 nt, Artificial Sequence
  Description of Artificial Sequence: Synthetic oligonucleotide
  Description of Combined DNA/RNA Molecule: Synthetic oligonucleotide
auuauuuauguaaaaugugaaaaaaaa

SEQ ID NO: 2438 - RNA, 27 nt, Artificial Sequence
  Description of Artificial Sequence: Synthetic oligonucleotide
  Description of Combined DNA/RNA Molecule: Synthetic oligonucleotide
uauuauuuauguaaaaugugaaaaaaa

SEQ ID NO: 2439 - RNA, 27 nt, Artificial Sequence
  Description of Artificial Sequence: Synthetic oligonucleotide
  Description of Combined DNA/RNA Molecule: Synthetic oligonucleotide
uuauuauuuauguaaaaugugaaaaaa

SEQ ID NO: 2440 - RNA, 27 nt, Artificial Sequence
  Description of Artificial Sequence: Synthetic oligonucleotide
  Description of Combined DNA/RNA Molecule: Synthetic oligonucleotide
aaagcauuauuauuuauguaaaaugug

SEQ ID NO: 2441 - RNA, 27 nt, Artificial Sequence
  Description of Artificial Sequence: Synthetic oligonucleotide
  Description of Combined DNA/RNA Molecule: Synthetic oligonucleotide
aaauauauugugcaauuguggcuacca

SEQ ID NO: 2442 - RNA, 27 nt, Artificial Sequence
  Description of Artificial Sequence: Synthetic oligonucleotide
  Description of Combined DNA/RNA Molecule: Synthetic oligonucleotide
cugguauuuuuuaagaaaauauauugu

SEQ ID NO: 2443 - RNA, 27 nt, Artificial Sequence
  Description of Artificial Sequence: Synthetic oligonucleotide
  Description of Combined DNA/RNA Molecule: Synthetic oligonucleotide
ugaguaacugcugguauuuuuuaagaa

SEQ ID NO: 2444 - RNA, 27 nt, Artificial Sequence
  Description of Artificial Sequence: Synthetic oligonucleotide
  Description of Combined DNA/RNA Molecule: Synthetic oligonucleotide
gcagaauauauuccaugaguaacugcu

SEQ ID NO: 2445 - RNA, 27 nt, Artificial Sequence
  Description of Artificial Sequence: Synthetic oligonucleotide
  Description of Combined DNA/RNA Molecule: Synthetic oligonucleotide
uuauaaacgcagaauauauuccaugag

SEQ ID NO: 2446 - RNA, 27 nt, Artificial Sequence
  Description of Artificial Sequence: Synthetic oligonucleotide
  Description of Combined DNA/RNA Molecule: Synthetic oligonucleotide
uuuauaaacgcagaauauauuccauga

SEQ ID NO: 2447 - RNA, 27 nt, Artificial Sequence
  Description of Artificial Sequence: Synthetic oligonucleotide
  Description of Combined DNA/RNA Molecule: Synthetic oligonucleotide
uuuuauaaacgcagaauauauuccaug

SEQ ID NO: 2448 - RNA, 27 nt, Artificial Sequence
  Description of Artificial Sequence: Synthetic oligonucleotide
  Description of Combined DNA/RNA Molecule: Synthetic oligonucleotide
guuuuauaaacgcagaauauauuccau

SEQ ID NO: 2449 - RNA, 27 nt, Artificial Sequence
  Description of Artificial Sequence: Synthetic oligonucleotide
  Description of Combined DNA/RNA Molecule: Synthetic oligonucleotide
aguuuuauaaacgcagaauauauucca

SEQ ID NO: 2450 - RNA, 27 nt, Artificial Sequence
  Description of Artificial Sequence: Synthetic oligonucleotide
  Description of Combined DNA/RNA Molecule: Synthetic oligonucleotide
uaguuuuauaaacgcagaauauauucc

SEQ ID NO: 2451 - RNA, 27 nt, Artificial Sequence
  Description of Artificial Sequence: Synthetic oligonucleotide
  Description of Combined DNA/RNA Molecule: Synthetic oligonucleotide
cuaguuuuauaaacgcagaauauauuc

SEQ ID NO: 2452 - RNA, 27 nt, Artificial Sequence
  Description of Artificial Sequence: Synthetic oligonucleotide
  Description of Combined DNA/RNA Molecule: Synthetic oligonucleotide
auuucuucuuaaaaacuaguuuuauaa

SEQ ID NO: 2453 - RNA, 27 nt, Artificial Sequence
  Description of Artificial Sequence: Synthetic oligonucleotide
  Description of Combined DNA/RNA Molecule: Synthetic oligonucleotide
aaaaaaauuucuucuuaaaaacuaguu

SEQ ID NO: 2454 - RNA, 27 nt, Artificial Sequence
  Description of Artificial Sequence: Synthetic oligonucleotide
  Description of Combined DNA/RNA Molecule: Synthetic oligonucleotide
aaaaaaaauuucuucuuaaaaacuagu

SEQ ID NO: 2455 - RNA, 27 nt, Artificial Sequence
  Description of Artificial Sequence: Synthetic oligonucleotide
  Description of Combined DNA/RNA Molecule: Synthetic oligonucleotide
caaaaaaaauuucuucuuaaaaacuag

SEQ ID NO: 2456 - RNA, 27 nt, Artificial Sequence
  Description of Artificial Sequence: Synthetic oligonucleotide
  Description of Combined DNA/RNA Molecule: Synthetic oligonucleotide
ccaaaaaaaauuucuucuuaaaaacua

SEQ ID NO: 2457 - RNA, 27 nt, Artificial Sequence
  Description of Artificial Sequence: Synthetic oligonucleotide
  Description of Combined DNA/RNA Molecule: Synthetic oligonucleotide
aggccaaaaaaaauuucuucuuaaaaa

SEQ ID NO: 2458 - RNA, 27 nt, Artificial Sequence
  Description of Artificial Sequence: Synthetic oligonucleotide
  Description of Combined DNA/RNA Molecule: Synthetic oligonucleotide
uuucauaggccaaaaaaaauuucuucu

SEQ ID NO: 2459 - RNA, 27 nt, Artificial Sequence
  Description of Artificial Sequence: Synthetic oligonucleotide
  Description of Combined DNA/RNA Molecule: Synthetic oligonucleotide
aauuucauaggccaaaaaaaauuucuu

SEQ ID NO: 2460 - RNA, 27 nt, Artificial Sequence
  Description of Artificial Sequence: Synthetic oligonucleotide
  Description of Combined DNA/RNA Molecule: Synthetic oligonucleotide
acaauuucauaggccaaaaaaaauuuc

SEQ ID NO: 2461 - RNA, 27 nt, Artificial Sequence
  Description of Artificial Sequence: Synthetic oligonucleotide
  Description of Combined DNA/RNA Molecule: Synthetic oligonucleotide
uaacaauuucauaggccaaaaaaaauu

SEQ ID NO: 2462 - RNA, 27 nt, Artificial Sequence
  Description of Artificial Sequence: Synthetic oligonucleotide
  Description of Combined DNA/RNA Molecule: Synthetic oligonucleotide
guuuaacaauuucauaggccaaaaaaa

SEQ ID NO: 2463 - RNA, 27 nt, Artificial Sequence
  Description of Artificial Sequence: Synthetic oligonucleotide
  Description of Combined DNA/RNA Molecule: Synthetic oligonucleotide
gguuuaacaauuucauaggccaaaaaa

SEQ ID NO: 2464 - RNA, 27 nt, Artificial Sequence
  Description of Artificial Sequence: Synthetic oligonucleotide
  Description of Combined DNA/RNA Molecule: Synthetic oligonucleotide
agguuuaacaauuucauaggccaaaaa

SEQ ID NO: 2465 - RNA, 27 nt, Artificial Sequence
  Description of Artificial Sequence: Synthetic oligonucleotide
  Description of Combined DNA/RNA Molecule: Synthetic oligonucleotide
cagguuuaacaauuucauaggccaaaa

SEQ ID NO: 2466 - RNA, 27 nt, Artificial Sequence
  Description of Artificial Sequence: Synthetic oligonucleotide
  Description of Combined DNA/RNA Molecule: Synthetic oligonucleotide
uguuccagguuuaacaauuucauaggc

SEQ ID NO: 2467 - RNA, 27 nt, Artificial Sequence
  Description of Artificial Sequence: Synthetic oligonucleotide
  Description of Combined DNA/RNA Molecule: Synthetic oligonucleotide
cauguuccagguuuaacaauuucauag

SEQ ID NO: 2468 - RNA, 27 nt, Artificial Sequence
  Description of Artificial Sequence: Synthetic oligonucleotide
  Description of Combined DNA/RNA Molecule: Synthetic oligonucleotide
augucauguuccagguuuaacaauuuc

SEQ ID NO: 2469 - RNA, 27 nt, Artificial Sequence
  Description of Artificial Sequence: Synthetic oligonucleotide
  Description of Combined DNA/RNA Molecule: Synthetic oligonucleotide
aaugucauguuccagguuuaacaauuu

SEQ ID NO: 2470 - RNA, 27 nt, Artificial Sequence
  Description of Artificial Sequence: Synthetic oligonucleotide
  Description of Combined DNA/RNA Molecule: Synthetic oligonucleotide
uaugauuaacaaugucauguuccaggu

SEQ ID NO: 2471 - RNA, 27 nt, Artificial Sequence
  Description of Artificial Sequence: Synthetic oligonucleotide
  Description of Combined DNA/RNA Molecule: Synthetic oligonucleotide
uuauuauaugauuaacaaugucauguu

SEQ ID NO: 2472 - RNA, 27 nt, Artificial Sequence
  Description of Artificial Sequence: Synthetic oligonucleotide
  Description of Combined DNA/RNA Molecule: Synthetic oligonucleotide
auuauuauaugauuaacaaugucaugu

SEQ ID NO: 2473 - RNA, 27 nt, Artificial Sequence
  Description of Artificial Sequence: Synthetic oligonucleotide
  Description of Combined DNA/RNA Molecule: Synthetic oligonucleotide
aaucauuauuauaugauuaacaauguc

SEQ ID NO: 2474 - RNA, 27 nt, Artificial Sequence
  Description of Artificial Sequence: Synthetic oligonucleotide
  Description of Combined DNA/RNA Molecule: Synthetic oligonucleotide
agaaucauuauuauaugauuaacaaug

SEQ ID NO: 2475 - RNA, 27 nt, Artificial Sequence
  Description of Artificial Sequence: Synthetic oligonucleotide
  Description of Combined DNA/RNA Molecule: Synthetic oligonucleotide
aagaaucauuauuauaugauuaacaau

SEQ ID NO: 2476 - RNA, 27 nt, Artificial Sequence
  Description of Artificial Sequence: Synthetic oligonucleotide
  Description of Combined DNA/RNA Molecule: Synthetic oligonucleotide
uaagaaucauuauuauaugauuaacaa

SEQ ID NO: 2477 - RNA, 27 nt, Artificial Sequence
  Description of Artificial Sequence: Synthetic oligonucleotide
  Description of Combined DNA/RNA Molecule: Synthetic oligonucleotide
cagcauuuaagaaucauuauuauauga

SEQ ID NO: 2478 - RNA, 27 nt, Artificial Sequence
  Description of Artificial Sequence: Synthetic oligonucleotide
  Description of Combined DNA/RNA Molecule: Synthetic oligonucleotide
acagcauuuaagaaucauuauuauaug

SEQ ID NO: 2479 - RNA, 27 nt, Artificial Sequence
  Description of Artificial Sequence: Synthetic oligonucleotide
  Description of Combined DNA/RNA Molecule: Synthetic oligonucleotide
ccauacagcauuuaagaaucauuauua

SEQ ID NO: 2480 - RNA, 27 nt, Artificial Sequence
  Description of Artificial Sequence: Synthetic oligonucleotide
  Description of Combined DNA/RNA Molecule: Synthetic oligonucleotide
aaaccauacagcauuuaagaaucauua

SEQ ID NO: 2481 - RNA, 27 nt, Artificial Sequence
  Description of Artificial Sequence: Synthetic oligonucleotide
  Description of Combined DNA/RNA Molecule: Synthetic oligonucleotide
uaaaccauacagcauuuaagaaucauu

SEQ ID NO: 2482 - RNA, 27 nt, Artificial Sequence
  Description of Artificial Sequence: Synthetic oligonucleotide
  Description of Combined DNA/RNA Molecule: Synthetic oligonucleotide
auaaaccauacagcauuuaagaaucau

SEQ ID NO: 2483 - RNA, 27 nt, Artificial Sequence
  Description of Artificial Sequence: Synthetic oligonucleotide
  Description of Combined DNA/RNA Molecule: Synthetic oligonucleotide
aaauaauaaaccauacagcauuuaaga

SEQ ID NO: 2484 - RNA, 27 nt, Artificial Sequence
  Description of Artificial Sequence: Synthetic oligonucleotide
  Description of Combined DNA/RNA Molecule: Synthetic oligonucleotide
uaaauaauaaaccauacagcauuuaag

SEQ ID NO: 2485 - RNA, 27 nt, Artificial Sequence
  Description of Artificial Sequence: Synthetic oligonucleotide
  Description of Combined DNA/RNA Molecule: Synthetic oligonucleotide
uuuaaauaauaaaccauacagcauuua

SEQ ID NO: 2486 - RNA, 27 nt, Artificial Sequence
  Description of Artificial Sequence: Synthetic oligonucleotide
  Description of Combined DNA/RNA Molecule: Synthetic oligonucleotide
uuacccauuuaaauaauaaaccauaca

SEQ ID NO: 2487 - RNA, 27 nt, Artificial Sequence
  Description of Artificial Sequence: Synthetic oligonucleotide
  Description of Combined DNA/RNA Molecule: Synthetic oligonucleotide
cuuuacccauuuaaauaauaaaccaua

SEQ ID NO: 2488 - RNA, 27 nt, Artificial Sequence
  Description of Artificial Sequence: Synthetic oligonucleotide
  Description of Combined DNA/RNA Molecule: Synthetic oligonucleotide
gcuuuacccauuuaaauaauaaaccau

SEQ ID NO: 2489 - RNA, 27 nt, Artificial Sequence
  Description of Artificial Sequence: Synthetic oligonucleotide
  Description of Combined DNA/RNA Molecule: Synthetic oligonucleotide
uggcuuuacccauuuaaauaauaaacc

SEQ ID NO: 2490 - RNA, 27 nt, Artificial Sequence
  Description of Artificial Sequence: Synthetic oligonucleotide
  Description of Combined DNA/RNA Molecule: Synthetic oligonucleotide
auggcuuuacccauuuaaauaauaaac

SEQ ID NO: 2491 - RNA, 27 nt, Artificial Sequence
  Description of Artificial Sequence: Synthetic oligonucleotide
  Description of Combined DNA/RNA Molecule: Synthetic oligonucleotide
uguaaauggcuuuacccauuuaaauaa

SEQ ID NO: 2492 - RNA, 27 nt, Artificial Sequence
  Description of Artificial Sequence: Synthetic oligonucleotide
  Description of Combined DNA/RNA Molecule: Synthetic oligonucleotide
auauuauguaaauggcuuuacccauuu

SEQ ID NO: 2493 - RNA, 27 nt, Artificial Sequence
  Description of Artificial Sequence: Synthetic oligonucleotide
  Description of Combined DNA/RNA Molecule: Synthetic oligonucleotide
ucuauauuauguaaauggcuuuaccca

SEQ ID NO: 2494 - RNA, 27 nt, Artificial Sequence
  Description of Artificial Sequence: Synthetic oligonucleotide
  Description of Combined DNA/RNA Molecule: Synthetic oligonucleotide
uuucuauauuauguaaauggcuuuacc

SEQ ID NO: 2495 - RNA, 27 nt, Artificial Sequence
  Description of Artificial Sequence: Synthetic oligonucleotide
  Description of Combined DNA/RNA Molecule: Synthetic oligonucleotide
cuuucuauauuauguaaauggcuuuac

SEQ ID NO: 2496 - RNA, 27 nt, Artificial Sequence
  Description of Artificial Sequence: Synthetic oligonucleotide
  Description of Combined DNA/RNA Molecule: Synthetic oligonucleotide
cauaucuuucuauauuauguaaauggc

SEQ ID NO: 2497 - RNA, 27 nt, Artificial Sequence
  Description of Artificial Sequence: Synthetic oligonucleotide
  Description of Combined DNA/RNA Molecule: Synthetic oligonucleotide
agauauaugcauaucuuucuauauuau

SEQ ID NO: 2498 - RNA, 27 nt, Artificial Sequence
  Description of Artificial Sequence: Synthetic oligonucleotide
  Description of Combined DNA/RNA Molecule: Synthetic oligonucleotide
uagauauaugcauaucuuucuauauua

SEQ ID NO: 2499 - RNA, 27 nt, Artificial Sequence
  Description of Artificial Sequence: Synthetic oligonucleotide
  Description of Combined DNA/RNA Molecule: Synthetic oligonucleotide
cuagauauaugcauaucuuucuauauu

SEQ ID NO: 2500 - RNA, 27 nt, Artificial Sequence
  Description of Artificial Sequence: Synthetic oligonucleotide
  Description of Combined DNA/RNA Molecule: Synthetic oligonucleotide
ccuucuagauauaugcauaucuuucua

SEQ ID NO: 2501 - RNA, 27 nt, Artificial Sequence
  Description of Artificial Sequence: Synthetic oligonucleotide
  Description of Combined DNA/RNA Molecule: Synthetic oligonucleotide
auaccuucuagauauaugcauaucuuu

SEQ ID NO: 2502 - RNA, 27 nt, Artificial Sequence
  Description of Artificial Sequence: Synthetic oligonucleotide
  Description of Combined DNA/RNA Molecule: Synthetic oligonucleotide
cauaccuucuagauauaugcauaucuu

SEQ ID NO: 2503 - RNA, 27 nt, Artificial Sequence
  Description of Artificial Sequence: Synthetic oligonucleotide
  Description of Combined DNA/RNA Molecule: Synthetic oligonucleotide
acauaccuucuagauauaugcauaucu

SEQ ID NO: 2504 - RNA, 27 nt, Artificial Sequence
  Description of Artificial Sequence: Synthetic oligonucleotide
  Description of Combined DNA/RNA Molecule: Synthetic oligonucleotide
augccacauaccuucuagauauaugca

SEQ ID NO: 2505 - RNA, 27 nt, Artificial Sequence
  Description of Artificial Sequence: Synthetic oligonucleotide
  Description of Combined DNA/RNA Molecule: Synthetic oligonucleotide
aaugccacauaccuucuagauauaugc

SEQ ID NO: 2506 - RNA, 27 nt, Artificial Sequence
  Description of Artificial Sequence: Synthetic oligonucleotide
  Description of Combined DNA/RNA Molecule: Synthetic oligonucleotide
ccaaauaaaugccacauaccuucuaga

SEQ ID NO: 2507 - RNA, 27 nt, Artificial Sequence
  Description of Artificial Sequence: Synthetic oligonucleotide
  Description of Combined DNA/RNA Molecule: Synthetic oligonucleotide
uuauccaaauaaaugccacauaccuuc

SEQ ID NO: 2508 - RNA, 27 nt, Artificial Sequence
  Description of Artificial Sequence: Synthetic oligonucleotide
  Description of Combined DNA/RNA Molecule: Synthetic oligonucleotide
aauuuuauccaaauaaaugccacauac

SEQ ID NO: 2509 - RNA, 27 nt, Artificial Sequence
  Description of Artificial Sequence: Synthetic oligonucleotide
  Description of Combined DNA/RNA Molecule: Synthetic oligonucleotide
agaauuuuauccaaauaaaugccacau

SEQ ID NO: 2510 - RNA, 27 nt, Artificial Sequence
  Description of Artificial Sequence: Synthetic oligonucleotide
  Description of Combined DNA/RNA Molecule: Synthetic oligonucleotide
cugaauugagaauuuuauccaaauaaa

SEQ ID NO: 2511 - RNA, 27 nt, Artificial Sequence
  Description of Artificial Sequence: Synthetic oligonucleotide
  Description of Combined DNA/RNA Molecule: Synthetic oligonucleotide
auuucucugaauugagaauuuuaucca

SEQ ID NO: 2512 - RNA, 27 nt, Artificial Sequence
  Description of Artificial Sequence: Synthetic oligonucleotide
  Description of Combined DNA/RNA Molecule: Synthetic oligonucleotide
ugauuucucugaauugagaauuuuauc

SEQ ID NO: 2513 - RNA, 27 nt, Artificial Sequence
  Description of Artificial Sequence: Synthetic oligonucleotide
  Description of Combined DNA/RNA Molecule: Synthetic oligonucleotide
gaugauuucucugaauugagaauuuua

SEQ ID NO: 2514 - RNA, 27 nt, Artificial Sequence
  Description of Artificial Sequence: Synthetic oligonucleotide
  Description of Combined DNA/RNA Molecule: Synthetic oligonucleotide
aaacaucagaugauuucucugaauuga

SEQ ID NO: 2515 - RNA, 27 nt, Artificial Sequence
  Description of Artificial Sequence: Synthetic oligonucleotide
  Description of Combined DNA/RNA Molecule: Synthetic oligonucleotide
auagaaacaucagaugauuucucugaa

SEQ ID NO: 2516 - RNA, 27 nt, Artificial Sequence
  Description of Artificial Sequence: Synthetic oligonucleotide
  Description of Combined DNA/RNA Molecule: Synthetic oligonucleotide
ugacuauagaaacaucagaugauuucu

SEQ ID NO: 2517 - RNA, 27 nt, Artificial Sequence
  Description of Artificial Sequence: Synthetic oligonucleotide
  Description of Combined DNA/RNA Molecule: Synthetic oligonucleotide
uggcaaagugacuauagaaacaucaga

SEQ ID NO: 2518 - RNA, 27 nt, Artificial Sequence
  Description of Artificial Sequence: Synthetic oligonucleotide
  Description of Combined DNA/RNA Molecule: Synthetic oligonucleotide
cuggcaaagugacuauagaaacaucag

SEQ ID NO: 2519 - RNA, 27 nt, Artificial Sequence
  Description of Artificial Sequence: Synthetic oligonucleotide
  Description of Combined DNA/RNA Molecule: Synthetic oligonucleotide
acuacauaggguauuguuuucuuuuga

SEQ ID NO: 2520 - RNA, 27 nt, Artificial Sequence
  Description of Artificial Sequence: Synthetic oligonucleotide
  Description of Combined DNA/RNA Molecule: Synthetic oligonucleotide
caacuacauaggguauuguuuucuuuu

SEQ ID NO: 2521 - RNA, 27 nt, Artificial Sequence
  Description of Artificial Sequence: Synthetic oligonucleotide
  Description of Combined DNA/RNA Molecule: Synthetic oligonucleotide
acaacuacauaggguauuguuuucuuu

SEQ ID NO: 2522 - RNA, 27 nt, Artificial Sequence
  Description of Artificial Sequence: Synthetic oligonucleotide
  Description of Combined DNA/RNA Molecule: Synthetic oligonucleotide
ccacaacuacauaggguauuguuuucu

SEQ ID NO: 2523 - RNA, 27 nt, Artificial Sequence
  Description of Artificial Sequence: Synthetic oligonucleotide
  Description of Combined DNA/RNA Molecule: Synthetic oligonucleotide
acuuccacaacuacauaggguauuguu

SEQ ID NO: 2524 - RNA, 27 nt, Artificial Sequence
  Description of Artificial Sequence: Synthetic oligonucleotide
  Description of Combined DNA/RNA Molecule: Synthetic oligonucleotide
uagcauaaacuuccacaacuacauagg

SEQ ID NO: 2525 - RNA, 27 nt, Artificial Sequence
  Description of Artificial Sequence: Synthetic oligonucleotide
  Description of Combined DNA/RNA Molecule: Synthetic oligonucleotide
uuagcauaaacuuccacaacuacauag

SEQ ID NO: 2526 - RNA, 27 nt, Artificial Sequence
  Description of Artificial Sequence: Synthetic oligonucleotide
  Description of Combined DNA/RNA Molecule: Synthetic oligonucleotide
caauauuagcauaaacuuccacaacua

SEQ ID NO: 2527 - RNA, 27 nt, Artificial Sequence
  Description of Artificial Sequence: Synthetic oligonucleotide
  Description of Combined DNA/RNA Molecule: Synthetic oligonucleotide
acaauauuagcauaaacuuccacaacu

SEQ ID NO: 2528 - RNA, 27 nt, Artificial Sequence
  Description of Artificial Sequence: Synthetic oligonucleotide
  Description of Combined DNA/RNA Molecule: Synthetic oligonucleotide
acacaauauuagcauaaacuuccacaa

SEQ ID NO: 2529 - RNA, 27 nt, Artificial Sequence
  Description of Artificial Sequence: Synthetic oligonucleotide
  Description of Combined DNA/RNA Molecule: Synthetic oligonucleotide
uuacacaauauuagcauaaacuuccac

SEQ ID NO: 2530 - RNA, 27 nt, Artificial Sequence
  Description of Artificial Sequence: Synthetic oligonucleotide
  Description of Combined DNA/RNA Molecule: Synthetic oligonucleotide
guuacacaauauuagcauaaacuucca

SEQ ID NO: 2531 - RNA, 27 nt, Artificial Sequence
  Description of Artificial Sequence: Synthetic oligonucleotide
  Description of Combined DNA/RNA Molecule: Synthetic oligonucleotide
aguuacacaauauuagcauaaacuucc

SEQ ID NO: 2532 - RNA, 27 nt, Artificial Sequence
  Description of Artificial Sequence: Synthetic oligonucleotide
  Description of Combined DNA/RNA Molecule: Synthetic oligonucleotide
ucaguuacacaauauuagcauaaacuu

SEQ ID NO: 2533 - RNA, 27 nt, Artificial Sequence
  Description of Artificial Sequence: Synthetic oligonucleotide
  Description of Combined DNA/RNA Molecule: Synthetic oligonucleotide
uuuaauaucaguuacacaauauuagca

SEQ ID NO: 2534 - RNA, 27 nt, Artificial Sequence
  Description of Artificial Sequence: Synthetic oligonucleotide
  Description of Combined DNA/RNA Molecule: Synthetic oligonucleotide
gguuuaauaucaguuacacaauauuag

SEQ ID NO: 2535 - RNA, 27 nt, Artificial Sequence
  Description of Artificial Sequence: Synthetic oligonucleotide
  Description of Combined DNA/RNA Molecule: Synthetic oligonucleotide
uagguuuaauaucaguuacacaauauu

SEQ ID NO: 2536 - RNA, 27 nt, Artificial Sequence
  Description of Artificial Sequence: Synthetic oligonucleotide
  Description of Combined DNA/RNA Molecule: Synthetic oligonucleotide
gcagaacauuuagguuuaauaucaguu

SEQ ID NO: 2537 - RNA, 27 nt, Artificial Sequence
  Description of Artificial Sequence: Synthetic oligonucleotide
  Description of Combined DNA/RNA Molecule: Synthetic oligonucleotide
cugcucaaaauaucuuuauaccaacag

SEQ ID NO: 2538 - RNA, 27 nt, Artificial Sequence
  Description of Artificial Sequence: Synthetic oligonucleotide
  Description of Combined DNA/RNA Molecule: Synthetic oligonucleotide
acagucugcucaaaauaucuuuauacc

SEQ ID NO: 2539 - RNA, 27 nt, Artificial Sequence
  Description of Artificial Sequence: Synthetic oligonucleotide
  Description of Combined DNA/RNA Molecule: Synthetic oligonucleotide
guuuacagucugcucaaaauaucuuua

SEQ ID NO: 2540 - RNA, 27 nt, Artificial Sequence
  Description of Artificial Sequence: Synthetic oligonucleotide
  Description of Combined DNA/RNA Molecule: Synthetic oligonucleotide
uguuuacagucugcucaaaauaucuuu

SEQ ID NO: 2541 - RNA, 27 nt, Artificial Sequence
  Description of Artificial Sequence: Synthetic oligonucleotide
  Description of Combined DNA/RNA Molecule: Synthetic oligonucleotide
uuguuuacagucugcucaaaauaucuu

SEQ ID NO: 2542 - RNA, 27 nt, Artificial Sequence
  Description of Artificial Sequence: Synthetic oligonucleotide
  Description of Combined DNA/RNA Molecule: Synthetic oligonucleotide
uuuucuuguuuacagucugcucaaaau

SEQ ID NO: 2543 - RNA, 27 nt, Artificial Sequence
  Description of Artificial Sequence: Synthetic oligonucleotide
  Description of Combined DNA/RNA Molecule: Synthetic oligonucleotide
uuuuuucuuguuuacagucugcucaaa

SEQ ID NO: 2544 - RNA, 27 nt, Artificial Sequence
  Description of Artificial Sequence: Synthetic oligonucleotide
  Description of Combined DNA/RNA Molecule: Synthetic oligonucleotide
uuuuuuuuuucuuguuuacagucugcu

SEQ ID NO: 2545 - RNA, 27 nt, Artificial Sequence
  Description of Artificial Sequence: Synthetic oligonucleotide
  Description of Combined DNA/RNA Molecule: Synthetic oligonucleotide
augauuuuuuuuuucuuguuuacaguc

SEQ ID NO: 2546 - RNA, 27 nt, Artificial Sequence
  Description of Artificial Sequence: Synthetic oligonucleotide
  Description of Combined DNA/RNA Molecule: Synthetic oligonucleotide
caugauuuuuuuuuucuuguuuacagu

SEQ ID NO: 2547 - RNA, 27 nt, Artificial Sequence
  Description of Artificial Sequence: Synthetic oligonucleotide
  Description of Combined DNA/RNA Molecule: Synthetic oligonucleotide
uugcuaagaaugcaugauuuuuuuuuu

SEQ ID NO: 2548 - RNA, 27 nt, Artificial Sequence
  Description of Artificial Sequence: Synthetic oligonucleotide
  Description of Combined DNA/RNA Molecule: Synthetic oligonucleotide
uuugcuaagaaugcaugauuuuuuuuu

SEQ ID NO: 2549 - RNA, 27 nt, Artificial Sequence
  Description of Artificial Sequence: Synthetic oligonucleotide
  Description of Combined DNA/RNA Molecule: Synthetic oligonucleotide
uaggcaauuuugcuaagaaugcaugau

SEQ ID NO: 2550 - RNA, 27 nt, Artificial Sequence
  Description of Artificial Sequence: Synthetic oligonucleotide
  Description of Combined DNA/RNA Molecule: Synthetic oligonucleotide
uaacauacuaggcaauuuugcuaagaa

SEQ ID NO: 2551 - RNA, 27 nt, Artificial Sequence
  Description of Artificial Sequence: Synthetic oligonucleotide
  Description of Combined DNA/RNA Molecule: Synthetic oligonucleotide
uuaacauacuaggcaauuuugcuaaga

SEQ ID NO: 2552 - RNA, 27 nt, Artificial Sequence
  Description of Artificial Sequence: Synthetic oligonucleotide
  Description of Combined DNA/RNA Molecule: Synthetic oligonucleotide
gcaaauuaacauacuaggcaauuuugc

SEQ ID NO: 2553 - RNA, 27 nt, Artificial Sequence
  Description of Artificial Sequence: Synthetic oligonucleotide
  Description of Combined DNA/RNA Molecule: Synthetic oligonucleotide
gagcaaauuaacauacuaggcaauuuu

SEQ ID NO: 2554 - RNA, 27 nt, Artificial Sequence
  Description of Artificial Sequence: Synthetic oligonucleotide
  Description of Combined DNA/RNA Molecule: Synthetic oligonucleotide
ugagcaaauuaacauacuaggcaauuu

SEQ ID NO: 2555 - RNA, 27 nt, Artificial Sequence
  Description of Artificial Sequence: Synthetic oligonucleotide
  Description of Combined DNA/RNA Molecule: Synthetic oligonucleotide
guauuuugagcaaauuaacauacuagg

SEQ ID NO: 2556 - RNA, 27 nt, Artificial Sequence
  Description of Artificial Sequence: Synthetic oligonucleotide
  Description of Combined DNA/RNA Molecule: Synthetic oligonucleotide
uguauuuugagcaaauuaacauacuag

SEQ ID NO: 2557 - RNA, 27 nt, Artificial Sequence
  Description of Artificial Sequence: Synthetic oligonucleotide
  Description of Combined DNA/RNA Molecule: Synthetic oligonucleotide
uuguauuuugagcaaauuaacauacua

SEQ ID NO: 2558 - RNA, 27 nt, Artificial Sequence
  Description of Artificial Sequence: Synthetic oligonucleotide
  Description of Combined DNA/RNA Molecule: Synthetic oligonucleotide
caaacauuguauuuugagcaaauuaac

SEQ ID NO: 2559 - RNA, 27 nt, Artificial Sequence
  Description of Artificial Sequence: Synthetic oligonucleotide
  Description of Combined DNA/RNA Molecule: Synthetic oligonucleotide
ucaaacauuguauuuugagcaaauuaa

SEQ ID NO: 2560 - RNA, 27 nt, Artificial Sequence
  Description of Artificial Sequence: Synthetic oligonucleotide
  Description of Combined DNA/RNA Molecule: Synthetic oligonucleotide
aaucaaacauuguauuuugagcaaauu

SEQ ID NO: 2561 - RNA, 27 nt, Artificial Sequence
  Description of Artificial Sequence: Synthetic oligonucleotide
  Description of Combined DNA/RNA Molecule: Synthetic oligonucleotide
gcauaaaaucaaacauuguauuuugag

SEQ ID NO: 2562 - RNA, 27 nt, Artificial Sequence
  Description of Artificial Sequence: Synthetic oligonucleotide
  Description of Combined DNA/RNA Molecule: Synthetic oligonucleotide
gugcauaaaaucaaacauuguauuuug

SEQ ID NO: 2563 - RNA, 27 nt, Artificial Sequence
  Description of Artificial Sequence: Synthetic oligonucleotide
  Description of Combined DNA/RNA Molecule: Synthetic oligonucleotide
agugcauaaaaucaaacauuguauuuu

SEQ ID NO: 2564 - RNA, 27 nt, Artificial Sequence
  Description of Artificial Sequence: Synthetic oligonucleotide
  Description of Combined DNA/RNA Molecule: Synthetic oligonucleotide
cgacaaagugcauaaaaucaaacauug

SEQ ID NO: 2565 - RNA, 27 nt, Artificial Sequence
  Description of Artificial Sequence: Synthetic oligonucleotide
  Description of Combined DNA/RNA Molecule: Synthetic oligonucleotide
gcgacaaagugcauaaaaucaaacauu

SEQ ID NO: 2566 - RNA, 27 nt, Artificial Sequence
  Description of Artificial Sequence: Synthetic oligonucleotide
  Description of Combined DNA/RNA Molecule: Synthetic oligonucleotide
gauguuaauagcgacaaagugcauaaa

SEQ ID NO: 2567 - RNA, 27 nt, Artificial Sequence
  Description of Artificial Sequence: Synthetic oligonucleotide
  Description of Combined DNA/RNA Molecule: Synthetic oligonucleotide
aaaaaaaggauguuaauagcgacaaag

SEQ ID NO: 2568 - RNA, 27 nt, Artificial Sequence
  Description of Artificial Sequence: Synthetic oligonucleotide
  Description of Combined DNA/RNA Molecule: Synthetic oligonucleotide
aauuauugaaaucuacaugaaaaaaag

SEQ ID NO: 2569 - RNA, 27 nt, Artificial Sequence
  Description of Artificial Sequence: Synthetic oligonucleotide
  Description of Combined DNA/RNA Molecule: Synthetic oligonucleotide
caauuauugaaaucuacaugaaaaaaa

SEQ ID NO: 2570 - RNA, 27 nt, Artificial Sequence
  Description of Artificial Sequence: Synthetic oligonucleotide
  Description of Combined DNA/RNA Molecule: Synthetic oligonucleotide
uuacucaauuauugaaaucuacaugaa

SEQ ID NO: 2571 - RNA, 27 nt, Artificial Sequence
  Description of Artificial Sequence: Synthetic oligonucleotide
  Description of Combined DNA/RNA Molecule: Synthetic oligonucleotide
auuacucaauuauugaaaucuacauga

SEQ ID NO: 2572 - RNA, 27 nt, Artificial Sequence
  Description of Artificial Sequence: Synthetic oligonucleotide
  Description of Combined DNA/RNA Molecule: Synthetic oligonucleotide
aauuacucaauuauugaaaucuacaug

SEQ ID NO: 2573 - RNA, 27 nt, Artificial Sequence
  Description of Artificial Sequence: Synthetic oligonucleotide
  Description of Combined DNA/RNA Molecule: Synthetic oligonucleotide
aaauuacucaauuauugaaaucuacau

SEQ ID NO: 2574 - RNA, 27 nt, Artificial Sequence
  Description of Artificial Sequence: Synthetic oligonucleotide
  Description of Combined DNA/RNA Molecule: Synthetic oligonucleotide
aaaauuacucaauuauugaaaucuaca

SEQ ID NO: 2575 - RNA, 27 nt, Artificial Sequence
  Description of Artificial Sequence: Synthetic oligonucleotide
  Description of Combined DNA/RNA Molecule: Synthetic oligonucleotide
uaaaauuacucaauuauugaaaucuac

SEQ ID NO: 2576 - RNA, 27 nt, Artificial Sequence
  Description of Artificial Sequence: Synthetic oligonucleotide
  Description of Combined DNA/RNA Molecule: Synthetic oligonucleotide
cuaaaauuacucaauuauugaaaucua

SEQ ID NO: 2577 - RNA, 27 nt, Artificial Sequence
  Description of Artificial Sequence: Synthetic oligonucleotide
  Description of Combined DNA/RNA Molecule: Synthetic oligonucleotide
ucuaaaauuacucaauuauugaaaucu

SEQ ID NO: 2578 - RNA, 27 nt, Artificial Sequence
  Description of Artificial Sequence: Synthetic oligonucleotide
  Description of Combined DNA/RNA Molecule: Synthetic oligonucleotide
aaugcuucuaaaauuacucaauuauug

SEQ ID NO: 2579 - RNA, 27 nt, Artificial Sequence
  Description of Artificial Sequence: Synthetic oligonucleotide
  Description of Combined DNA/RNA Molecule: Synthetic oligonucleotide
aaauaaugcuucuaaaauuacucaauu

SEQ ID NO: 2580 - RNA, 27 nt, Artificial Sequence
  Description of Artificial Sequence: Synthetic oligonucleotide
  Description of Combined DNA/RNA Molecule: Synthetic oligonucleotide
aaaauaaugcuucuaaaauuacucaau

SEQ ID NO: 2581 - RNA, 27 nt, Artificial Sequence
  Description of Artificial Sequence: Synthetic oligonucleotide
  Description of Combined DNA/RNA Molecule: Synthetic oligonucleotide
cuaaaauaaugcuucuaaaauuacuca

SEQ ID NO: 2582 - RNA, 27 nt, Artificial Sequence
  Description of Artificial Sequence: Synthetic oligonucleotide
  Description of Combined DNA/RNA Molecule: Synthetic oligonucleotide
auuccuaaaauaaugcuucuaaaauua

SEQ ID NO: 2583 - RNA, 27 nt, Artificial Sequence
  Description of Artificial Sequence: Synthetic oligonucleotide
  Description of Combined DNA/RNA Molecule: Synthetic oligonucleotide
auauauuccuaaaauaaugcuucuaaa

SEQ ID NO: 2584 - RNA, 27 nt, Artificial Sequence
  Description of Artificial Sequence: Synthetic oligonucleotide
  Description of Combined DNA/RNA Molecule: Synthetic oligonucleotide
cuauauauuccuaaaauaaugcuucua

SEQ ID NO: 2585 - RNA, 27 nt, Artificial Sequence
  Description of Artificial Sequence: Synthetic oligonucleotide
  Description of Combined DNA/RNA Molecule: Synthetic oligonucleotide
acaacuauauauuccuaaaauaaugcu

SEQ ID NO: 2586 - RNA, 27 nt, Artificial Sequence
  Description of Artificial Sequence: Synthetic oligonucleotide
  Description of Combined DNA/RNA Molecule: Synthetic oligonucleotide
ugacaacuauauauuccuaaaauaaug

SEQ ID NO: 2587 - RNA, 27 nt, Artificial Sequence
  Description of Artificial Sequence: Synthetic oligonucleotide
  Description of Combined DNA/RNA Molecule: Synthetic oligonucleotide
auuuacugugacaacuauauauuccua

SEQ ID NO: 2588 - RNA, 27 nt, Artificial Sequence
  Description of Artificial Sequence: Synthetic oligonucleotide
  Description of Combined DNA/RNA Molecule: Synthetic oligonucleotide
uauuuacugugacaacuauauauuccu

SEQ ID NO: 2589 - RNA, 27 nt, Artificial Sequence
  Description of Artificial Sequence: Synthetic oligonucleotide
  Description of Combined DNA/RNA Molecule: Synthetic oligonucleotide
auauuuacugugacaacuauauauucc

SEQ ID NO: 2590 - RNA, 27 nt, Artificial Sequence
  Description of Artificial Sequence: Synthetic oligonucleotide
  Description of Combined DNA/RNA Molecule: Synthetic oligonucleotide
agauauuuacugugacaacuauauauu

SEQ ID NO: 2591 - RNA, 27 nt, Artificial Sequence
  Description of Artificial Sequence: Synthetic oligonucleotide
  Description of Combined DNA/RNA Molecule: Synthetic oligonucleotide
aagauauuuacugugacaacuauauau

SEQ ID NO: 2592 - RNA, 27 nt, Artificial Sequence
  Description of Artificial Sequence: Synthetic oligonucleotide
  Description of Combined DNA/RNA Molecule: Synthetic oligonucleotide
aaaacaagauauuuacugugacaacua

SEQ ID NO: 2593 - RNA, 27 nt, Artificial Sequence
  Description of Artificial Sequence: Synthetic oligonucleotide
  Description of Combined DNA/RNA Molecule: Synthetic oligonucleotide
aaaaacaagauauuuacugugacaacu

SEQ ID NO: 2594 - RNA, 27 nt, Artificial Sequence
  Description of Artificial Sequence: Synthetic oligonucleotide
  Description of Combined DNA/RNA Molecule: Synthetic oligonucleotide
uguacauagaaaaaacaagauauuuac

SEQ ID NO: 2595 - RNA, 27 nt, Artificial Sequence
  Description of Artificial Sequence: Synthetic oligonucleotide
  Description of Combined DNA/RNA Molecule: Synthetic oligonucleotide
auguacauagaaaaaacaagauauuua

SEQ ID NO: 2596 - RNA, 27 nt, Artificial Sequence
  Description of Artificial Sequence: Synthetic oligonucleotide
  Description of Combined DNA/RNA Molecule: Synthetic oligonucleotide
guacaauguacauagaaaaaacaagau

SEQ ID NO: 2597 - RNA, 27 nt, Artificial Sequence
  Description of Artificial Sequence: Synthetic oligonucleotide
  Description of Combined DNA/RNA Molecule: Synthetic oligonucleotide
uguacaauguacauagaaaaaacaaga

SEQ ID NO: 2598 - RNA, 27 nt, Artificial Sequence
  Description of Artificial Sequence: Synthetic oligonucleotide
  Description of Combined DNA/RNA Molecule: Synthetic oligonucleotide
uuguacaauguacauagaaaaaacaag

SEQ ID NO: 2599 - RNA, 27 nt, Artificial Sequence
  Description of Artificial Sequence: Synthetic oligonucleotide
  Description of Combined DNA/RNA Molecule: Synthetic oligonucleotide
uuuguacaauguacauagaaaaaacaa

SEQ ID NO: 2600 - RNA, 27 nt, Artificial Sequence
  Description of Artificial Sequence: Synthetic oligonucleotide
  Description of Combined DNA/RNA Molecule: Synthetic oligonucleotide
ugaaaaauuuguacaauguacauagaa

SEQ ID NO: 2601 - RNA, 27 nt, Artificial Sequence
  Description of Artificial Sequence: Synthetic oligonucleotide
  Description of Combined DNA/RNA Molecule: Synthetic oligonucleotide
augaaaaauuuguacaauguacauaga

SEQ ID NO: 2602 - RNA, 27 nt, Artificial Sequence
  Description of Artificial Sequence: Synthetic oligonucleotide
  Description of Combined DNA/RNA Molecule: Synthetic oligonucleotide
ccacaaagagcaaaaggaaugaaaaau

SEQ ID NO: 2603 - RNA, 27 nt, Artificial Sequence
  Description of Artificial Sequence: Synthetic oligonucleotide
  Description of Combined DNA/RNA Molecule: Synthetic oligonucleotide
caauacaguuaguguuagauccaacca

SEQ ID NO: 2604 - RNA, 27 nt, Artificial Sequence
  Description of Artificial Sequence: Synthetic oligonucleotide
  Description of Combined DNA/RNA Molecule: Synthetic oligonucleotide
acaauacaguuaguguuagauccaacc

SEQ ID NO: 2605 - RNA, 27 nt, Artificial Sequence
  Description of Artificial Sequence: Synthetic oligonucleotide
  Description of Combined DNA/RNA Molecule: Synthetic oligonucleotide
aaacaauacaguuaguguuagauccaa

SEQ ID NO: 2606 - RNA, 27 nt, Artificial Sequence
  Description of Artificial Sequence: Synthetic oligonucleotide
  Description of Combined DNA/RNA Molecule: Synthetic oligonucleotide
uuuauuugauguaacaaaacaauacag

SEQ ID NO: 2607 - RNA, 27 nt, Artificial Sequence
  Description of Artificial Sequence: Synthetic oligonucleotide
  Description of Combined DNA/RNA Molecule: Synthetic oligonucleotide
guuuauuugauguaacaaaacaauaca

SEQ ID NO: 2608 - RNA, 27 nt, Artificial Sequence
  Description of Artificial Sequence: Synthetic oligonucleotide
  Description of Combined DNA/RNA Molecule: Synthetic oligonucleotide
uguuuauuugauguaacaaaacaauac

SEQ ID NO: 2609 - RNA, 27 nt, Artificial Sequence
  Description of Artificial Sequence: Synthetic oligonucleotide
  Description of Combined DNA/RNA Molecule: Synthetic oligonucleotide
gauguuuauuugauguaacaaaacaau

SEQ ID NO: 2610 - RNA, 27 nt, Artificial Sequence
  Description of Artificial Sequence: Synthetic oligonucleotide
  Description of Combined DNA/RNA Molecule: Synthetic oligonucleotide
uuuuuuuuuuuuugccugguccacaga

SEQ ID NO: 2611 - RNA, 27 nt, Artificial Sequence
  Description of Artificial Sequence: Synthetic oligonucleotide
  Description of Combined DNA/RNA Molecule: Synthetic oligonucleotide
uuuuuuuuuuuuuugccugguccacag

SEQ ID NO: 2612 - RNA, 27 nt, Artificial Sequence
  Description of Artificial Sequence: Synthetic oligonucleotide
  Description of Combined DNA/RNA Molecule: Synthetic oligonucleotide
uuuuuuuuuuuuuuuuuuuugccuggu

SEQ ID NO: 2613 - RNA, 27 nt, Artificial Sequence
  Description of Artificial Sequence: Synthetic oligonucleotide
  Description of Combined DNA/RNA Molecule: Synthetic oligonucleotide
aaauaauuccuacugcuugaaaaagug

SEQ ID NO: 2614 - RNA, 27 nt, Artificial Sequence
  Description of Artificial Sequence: Synthetic oligonucleotide
  Description of Combined DNA/RNA Molecule: Synthetic oligonucleotide
uaaauaauuccuacugcuugaaaaagu

SEQ ID NO: 2615 - RNA, 27 nt, Artificial Sequence
  Description of Artificial Sequence: Synthetic oligonucleotide
  Description of Combined DNA/RNA Molecule: Synthetic oligonucleotide
caugcuaaauaauuccuacugcuugaa

SEQ ID NO: 2616 - RNA, 27 nt, Artificial Sequence
  Description of Artificial Sequence: Synthetic oligonucleotide
  Description of Combined DNA/RNA Molecule: Synthetic oligonucleotide
ucuacaugcuaaauaauuccuacugcu

SEQ ID NO: 2617 - RNA, 27 nt, Artificial Sequence
  Description of Artificial Sequence: Synthetic oligonucleotide
  Description of Combined DNA/RNA Molecule: Synthetic oligonucleotide
agucuacaugcuaaauaauuccuacug

SEQ ID NO: 2618 - RNA, 27 nt, Artificial Sequence
  Description of Artificial Sequence: Synthetic oligonucleotide
  Description of Combined DNA/RNA Molecule: Synthetic oligonucleotide
cagucuacaugcuaaauaauuccuacu

SEQ ID NO: 2619 - RNA, 27 nt, Artificial Sequence
  Description of Artificial Sequence: Synthetic oligonucleotide
  Description of Combined DNA/RNA Molecule: Synthetic oligonucleotide
gcagucuacaugcuaaauaauuccuac

SEQ ID NO: 2620 - DNA, 25 bp, Artificial Sequence
  Description of Artificial Sequence: Synthetic oligonucleotide
  Description of Combined DNA/RNA Molecule: Synthetic oligonucleotide
agauaaguucugaacgucgaaaaga

SEQ ID NO: 2621 - DNA, 25 bp, Artificial Sequence
  Description of Artificial Sequence: Synthetic oligonucleotide
  Description of Combined DNA/RNA Molecule: Synthetic oligonucleotide
uaaguucugaacgucgaaaagaaaa

SEQ ID NO: 2622 - DNA, 25 bp, Artificial Sequence
  Description of Artificial Sequence: Synthetic oligonucleotide
  Description of Combined DNA/RNA Molecule: Synthetic oligonucleotide
aguucugaacgucgaaaagaaaagt

SEQ ID NO: 2623 - DNA, 25 bp, Artificial Sequence
  Description of Artificial Sequence: Synthetic oligonucleotide
  Description of Combined DNA/RNA Molecule: Synthetic oligonucleotide
cugaacgucgaaaagaaaagucucg

SEQ ID NO: 2624 - DNA, 25 bp, Artificial Sequence
  Description of Artificial Sequence: Synthetic oligonucleotide
  Description of Combined DNA/RNA Molecule: Synthetic oligonucleotide
cgaaaagaaaagucucgagaugcag

SEQ ID NO: 2625 - DNA, 25 bp, Artificial Sequence
  Description of Artificial Sequence: Synthetic oligonucleotide
  Description of Combined DNA/RNA Molecule: Synthetic oligonucleotide
gaaaagaaaagucucgagaugcagc

SEQ ID NO: 2626 - DNA, 25 bp, Artificial Sequence
  Description of Artificial Sequence: Synthetic oligonucleotide
  Description of Combined DNA/RNA Molecule: Synthetic oligonucleotide
cgaaguaaagaaucugaaguuuutt

SEQ ID NO: 2627 - DNA, 25 bp, Artificial Sequence
  Description of Artificial Sequence: Synthetic oligonucleotide
  Description of Combined DNA/RNA Molecule: Synthetic oligonucleotide
gaaguaaagaaucugaaguuuuuta

SEQ ID NO: 2628 - DNA, 25 bp, Artificial Sequence
  Description of Artificial Sequence: Synthetic oligonucleotide
  Description of Combined DNA/RNA Molecule: Synthetic oligonucleotide
aguaaagaaucugaaguuuuuuatg

SEQ ID NO: 2629 - DNA, 25 bp, Artificial Sequence
  Description of Artificial Sequence: Synthetic oligonucleotide
  Description of Combined DNA/RNA Molecule: Synthetic oligonucleotide
guaaagaaucugaaguuuuuuauga

SEQ ID NO: 2630 - DNA, 25 bp, Artificial Sequence
  Description of Artificial Sequence: Synthetic oligonucleotide
  Description of Combined DNA/RNA Molecule: Synthetic oligonucleotide
aaagaaucugaaguuuuuuaugagc

SEQ ID NO: 2631 - DNA, 25 bp, Artificial Sequence
  Description of Artificial Sequence: Synthetic oligonucleotide
  Description of Combined DNA/RNA Molecule: Synthetic oligonucleotide
cugaaguuuuuuaugagcuugcuca

SEQ ID NO: 2632 - DNA, 25 bp, Artificial Sequence
  Description of Artificial Sequence: Synthetic oligonucleotide
  Description of Combined DNA/RNA Molecule: Synthetic oligonucleotide
guugccacuuccacauaaugugagt

SEQ ID NO: 2633 - DNA, 25 bp, Artificial Sequence
  Description of Artificial Sequence: Synthetic oligonucleotide
  Description of Combined DNA/RNA Molecule: Synthetic oligonucleotide
gugaguucgcaucuugauaaggcct

SEQ ID NO: 2634 - DNA, 25 bp, Artificial Sequence
  Description of Artificial Sequence: Synthetic oligonucleotide
  Description of Combined DNA/RNA Molecule: Synthetic oligonucleotide
gaggcuuaccaucagcuauuugcgt

SEQ ID NO: 2635 - DNA, 25 bp, Artificial Sequence
  Description of Artificial Sequence: Synthetic oligonucleotide
  Description of Combined DNA/RNA Molecule: Synthetic oligonucleotide
aggaaacuucuggaugcuggugatt

SEQ ID NO: 2636 - DNA, 25 bp, Artificial Sequence
  Description of Artificial Sequence: Synthetic oligonucleotide
  Description of Combined DNA/RNA Molecule: Synthetic oligonucleotide
cuggugauuuggauauugaagauga

SEQ ID NO: 2637 - DNA, 25 bp, Artificial Sequence
  Description of Artificial Sequence: Synthetic oligonucleotide
  Description of Combined DNA/RNA Molecule: Synthetic oligonucleotide
ggugauuuggauauugaagaugaca

SEQ ID NO: 2638 - DNA, 25 bp, Artificial Sequence
  Description of Artificial Sequence: Synthetic oligonucleotide
  Description of Combined DNA/RNA Molecule: Synthetic oligonucleotide
uuggauauugaagaugacaugaaag

SEQ ID NO: 2639 - DNA, 25 bp, Artificial Sequence
  Description of Artificial Sequence: Synthetic oligonucleotide
  Description of Combined DNA/RNA Molecule: Synthetic oligonucleotide
uggauauugaagaugacaugaaagc

SEQ ID NO: 2640 - DNA, 25 bp, Artificial Sequence
  Description of Artificial Sequence: Synthetic oligonucleotide
  Description of Combined DNA/RNA Molecule: Synthetic oligonucleotide
gauauugaagaugacaugaaagcac

SEQ ID NO: 2641 - DNA, 25 bp, Artificial Sequence
  Description of Artificial Sequence: Synthetic oligonucleotide
  Description of Combined DNA/RNA Molecule: Synthetic oligonucleotide
auauugaagaugacaugaaagcaca

SEQ ID NO: 2642 - DNA, 25 bp, Artificial Sequence
  Description of Artificial Sequence: Synthetic oligonucleotide
  Description of Combined DNA/RNA Molecule: Synthetic oligonucleotide
agaugacaugaaagcacagaugaat

SEQ ID NO: 2643 - DNA, 25 bp, Artificial Sequence
  Description of Artificial Sequence: Synthetic oligonucleotide
  Description of Combined DNA/RNA Molecule: Synthetic oligonucleotide
gaugacaugaaagcacagaugaatt

SEQ ID NO: 2644 - DNA, 25 bp, Artificial Sequence
  Description of Artificial Sequence: Synthetic oligonucleotide
  Description of Combined DNA/RNA Molecule: Synthetic oligonucleotide
aaagcacagaugaauugcuuuuatt

SEQ ID NO: 2645 - DNA, 25 bp, Artificial Sequence
  Description of Artificial Sequence: Synthetic oligonucleotide
  Description of Combined DNA/RNA Molecule: Synthetic oligonucleotide
cagaugaauugcuuuuauuugaaag

SEQ ID NO: 2646 - DNA, 25 bp, Artificial Sequence
  Description of Artificial Sequence: Synthetic oligonucleotide
  Description of Combined DNA/RNA Molecule: Synthetic oligonucleotide
agaugaauugcuuuuauuugaaagc

SEQ ID NO: 2647 - DNA, 25 bp, Artificial Sequence
  Description of Artificial Sequence: Synthetic oligonucleotide
  Description of Combined DNA/RNA Molecule: Synthetic oligonucleotide
uuauuugaaagccuuggaugguutt

SEQ ID NO: 2648 - DNA, 25 bp, Artificial Sequence
  Description of Artificial Sequence: Synthetic oligonucleotide
  Description of Combined DNA/RNA Molecule: Synthetic oligonucleotide
uauuugaaagccuuggaugguuutg

SEQ ID NO: 2649 - DNA, 25 bp, Artificial Sequence
  Description of Artificial Sequence: Synthetic oligonucleotide
  Description of Combined DNA/RNA Molecule: Synthetic oligonucleotide
aaagccuuggaugguuuuguuaugg

SEQ ID NO: 2650 - DNA, 25 bp, Artificial Sequence
  Description of Artificial Sequence: Synthetic oligonucleotide
  Description of Combined DNA/RNA Molecule: Synthetic oligonucleotide
uuuguuaugguucucacagaugatg

SEQ ID NO: 2651 - DNA, 25 bp, Artificial Sequence
  Description of Artificial Sequence: Synthetic oligonucleotide
  Description of Combined DNA/RNA Molecule: Synthetic oligonucleotide
augguucucacagaugauggugaca

SEQ ID NO: 2652 - DNA, 25 bp, Artificial Sequence
  Description of Artificial Sequence: Synthetic oligonucleotide
  Description of Combined DNA/RNA Molecule: Synthetic oligonucleotide
ugguucucacagaugauggugacat

SEQ ID NO: 2653 - DNA, 25 bp, Artificial Sequence
  Description of Artificial Sequence: Synthetic oligonucleotide
  Description of Combined DNA/RNA Molecule: Synthetic oligonucleotide
cagaugauggugacaugauuuacat

SEQ ID NO: 2654 - DNA, 25 bp, Artificial Sequence
  Description of Artificial Sequence: Synthetic oligonucleotide
  Description of Combined DNA/RNA Molecule: Synthetic oligonucleotide
gauggugacaugauuuacauuuctg

SEQ ID NO: 2655 - DNA, 25 bp, Artificial Sequence
  Description of Artificial Sequence: Synthetic oligonucleotide
  Description of Combined DNA/RNA Molecule: Synthetic oligonucleotide
auggugacaugauuuacauuucuga

SEQ ID NO: 2656 - DNA, 25 bp, Artificial Sequence
  Description of Artificial Sequence: Synthetic oligonucleotide
  Description of Combined DNA/RNA Molecule: Synthetic oligonucleotide
augauuuacauuucugauaauguga

SEQ ID NO: 2657 - DNA, 25 bp, Artificial Sequence
  Description of Artificial Sequence: Synthetic oligonucleotide
  Description of Combined DNA/RNA Molecule: Synthetic oligonucleotide
gauuuacauuucugauaaugugaac

SEQ ID NO: 2658 - DNA, 25 bp, Artificial Sequence
  Description of Artificial Sequence: Synthetic oligonucleotide
  Description of Combined DNA/RNA Molecule: Synthetic oligonucleotide
uuuacauuucugauaaugugaacaa

SEQ ID NO: 2659 - DNA, 25 bp, Artificial Sequence
  Description of Artificial Sequence: Synthetic oligonucleotide
  Description of Combined DNA/RNA Molecule: Synthetic oligonucleotide
auuucugauaaugugaacaaauaca

SEQ ID NO: 2660 - DNA, 25 bp, Artificial Sequence
  Description of Artificial Sequence: Synthetic oligonucleotide
  Description of Combined DNA/RNA Molecule: Synthetic oligonucleotide
uaaugugaacaaauacaugggauta

SEQ ID NO: 2661 - DNA, 25 bp, Artificial Sequence
  Description of Artificial Sequence: Synthetic oligonucleotide
  Description of Combined DNA/RNA Molecule: Synthetic oligonucleotide
aaugugaacaaauacaugggauuaa

SEQ ID NO: 2662 - DNA, 25 bp, Artificial Sequence
  Description of Artificial Sequence: Synthetic oligonucleotide
  Description of Combined DNA/RNA Molecule: Synthetic oligonucleotide
augugaacaaauacaugggauuaac

SEQ ID NO: 2663 - DNA, 25 bp, Artificial Sequence
  Description of Artificial Sequence: Synthetic oligonucleotide
  Description of Combined DNA/RNA Molecule: Synthetic oligonucleotide
ugugaacaaauacaugggauuaact

SEQ ID NO: 2664 - DNA, 25 bp, Artificial Sequence
  Description of Artificial Sequence: Synthetic oligonucleotide
  Description of Combined DNA/RNA Molecule: Synthetic oligonucleotide
gugaacaaauacaugggauuaactc

SEQ ID NO: 2665 - DNA, 25 bp, Artificial Sequence
  Description of Artificial Sequence: Synthetic oligonucleotide
  Description of Combined DNA/RNA Molecule: Synthetic oligonucleotide
ugaacaaauacaugggauuaacuca

SEQ ID NO: 2666 - DNA, 25 bp, Artificial Sequence
  Description of Artificial Sequence: Synthetic oligonucleotide
  Description of Combined DNA/RNA Molecule: Synthetic oligonucleotide
caugggauuaacucaguuugaacta

SEQ ID NO: 2667 - DNA, 25 bp, Artificial Sequence
  Description of Artificial Sequence: Synthetic oligonucleotide
  Description of Combined DNA/RNA Molecule: Synthetic oligonucleotide
augggauuaacucaguuugaacuaa

SEQ ID NO: 2668 - DNA, 25 bp, Artificial Sequence
  Description of Artificial Sequence: Synthetic oligonucleotide
  Description of Combined DNA/RNA Molecule: Synthetic oligonucleotide
uuugaacuaacuggacacagugugt

SEQ ID NO: 2669 - DNA, 25 bp, Artificial Sequence
  Description of Artificial Sequence: Synthetic oligonucleotide
  Description of Combined DNA/RNA Molecule: Synthetic oligonucleotide
cuggacacaguguguuugauuuuac

SEQ ID NO: 2670 - DNA, 25 bp, Artificial Sequence
  Description of Artificial Sequence: Synthetic oligonucleotide
  Description of Combined DNA/RNA Molecule: Synthetic oligonucleotide
uggacacaguguguuugauuuuact

SEQ ID NO: 2671 - DNA, 25 bp, Artificial Sequence
  Description of Artificial Sequence: Synthetic oligonucleotide
  Description of Combined DNA/RNA Molecule: Synthetic oligonucleotide
uuugauuuuacucauccaugugacc

SEQ ID NO: 2672 - DNA, 25 bp, Artificial Sequence
  Description of Artificial Sequence: Synthetic oligonucleotide
  Description of Combined DNA/RNA Molecule: Synthetic oligonucleotide
ugauuuuacucauccaugugaccat

SEQ ID NO: 2673 - DNA, 25 bp, Artificial Sequence
  Description of Artificial Sequence: Synthetic oligonucleotide
  Description of Combined DNA/RNA Molecule: Synthetic oligonucleotide
caugugaccaugaggaaaugagaga

SEQ ID NO: 2674 - DNA, 25 bp, Artificial Sequence
  Description of Artificial Sequence: Synthetic oligonucleotide
  Description of Combined DNA/RNA Molecule: Synthetic oligonucleotide
ugugaccaugaggaaaugagagaaa

SEQ ID NO: 2675 - DNA, 25 bp, Artificial Sequence
  Description of Artificial Sequence: Synthetic oligonucleotide
  Description of Combined DNA/RNA Molecule: Synthetic oligonucleotide
caugaggaaaugagagaaaugcuta

SEQ ID NO: 2676 - DNA, 25 bp, Artificial Sequence
  Description of Artificial Sequence: Synthetic oligonucleotide
  Description of Combined DNA/RNA Molecule: Synthetic oligonucleotide
agagaaaugcuuacacacagaaatg

SEQ ID NO: 2677 - DNA, 25 bp, Artificial Sequence
  Description of Artificial Sequence: Synthetic oligonucleotide
  Description of Combined DNA/RNA Molecule: Synthetic oligonucleotide
aaaugcuuacacacagaaauggcct

SEQ ID NO: 2678 - DNA, 25 bp, Artificial Sequence
  Description of Artificial Sequence: Synthetic oligonucleotide
  Description of Combined DNA/RNA Molecule: Synthetic oligonucleotide
aaugcuuacacacagaaauggcctt

SEQ ID NO: 2679 - DNA, 25 bp, Artificial Sequence
  Description of Artificial Sequence: Synthetic oligonucleotide
  Description of Combined DNA/RNA Molecule: Synthetic oligonucleotide
gaaauggccuugugaaaaaggguaa

SEQ ID NO: 2680 - DNA, 25 bp, Artificial Sequence
  Description of Artificial Sequence: Synthetic oligonucleotide
  Description of Combined DNA/RNA Molecule: Synthetic oligonucleotide
aaauggccuugugaaaaaggguaaa

SEQ ID NO: 2681 - DNA, 25 bp, Artificial Sequence
  Description of Artificial Sequence: Synthetic oligonucleotide
  Description of Combined DNA/RNA Molecule: Synthetic oligonucleotide
aauggccuugugaaaaaggguaaag

SEQ ID NO: 2682 - DNA, 25 bp, Artificial Sequence
  Description of Artificial Sequence: Synthetic oligonucleotide
  Description of Combined DNA/RNA Molecule: Synthetic oligonucleotide
auggccuugugaaaaaggguaaaga

SEQ ID NO: 2683 - DNA, 25 bp, Artificial Sequence
  Description of Artificial Sequence: Synthetic oligonucleotide
  Description of Combined DNA/RNA Molecule: Synthetic oligonucleotide
cuugugaaaaaggguaaagaacaaa

SEQ ID NO: 2684 - DNA, 25 bp, Artificial Sequence
  Description of Artificial Sequence: Synthetic oligonucleotide
  Description of Combined DNA/RNA Molecule: Synthetic oligonucleotide
aagaacaaaacacacagcgaagctt

SEQ ID NO: 2685 - DNA, 25 bp, Artificial Sequence
  Description of Artificial Sequence: Synthetic oligonucleotide
  Description of Combined DNA/RNA Molecule: Synthetic oligonucleotide
cuuuuuucucagaaugaaguguacc

SEQ ID NO: 2686 - DNA, 25 bp, Artificial Sequence
  Description of Artificial Sequence: Synthetic oligonucleotide
  Description of Combined DNA/RNA Molecule: Synthetic oligonucleotide
uuuuucucagaaugaaguguaccct

SEQ ID NO: 2687 - DNA, 25 bp, Artificial Sequence
  Description of Artificial Sequence: Synthetic oligonucleotide
  Description of Combined DNA/RNA Molecule: Synthetic oligonucleotide
aaugaaguguacccuaacuagccga

SEQ ID NO: 2688 - DNA, 25 bp, Artificial Sequence
  Description of Artificial Sequence: Synthetic oligonucleotide
  Description of Combined DNA/RNA Molecule: Synthetic oligonucleotide
aggaagaacuaugaacauaaaguct

SEQ ID NO: 2689 - DNA, 25 bp, Artificial Sequence
  Description of Artificial Sequence: Synthetic oligonucleotide
  Description of Combined DNA/RNA Molecule: Synthetic oligonucleotide
ggaagaacuaugaacauaaaguctg

SEQ ID NO: 2690 - DNA, 25 bp, Artificial Sequence
  Description of Artificial Sequence: Synthetic oligonucleotide
  Description of Combined DNA/RNA Molecule: Synthetic oligonucleotide
gaagaacuaugaacauaaagucugc

SEQ ID NO: 2691 - DNA, 25 bp, Artificial Sequence
  Description of Artificial Sequence: Synthetic oligonucleotide
  Description of Combined DNA/RNA Molecule: Synthetic oligonucleotide
caggccacauucacguauaugauac

SEQ ID NO: 2692 - DNA, 25 bp, Artificial Sequence
  Description of Artificial Sequence: Synthetic oligonucleotide
  Description of Combined DNA/RNA Molecule: Synthetic oligonucleotide
uggguauaagaaaccaccuaugacc

SEQ ID NO: 2693 - DNA, 25 bp, Artificial Sequence
  Description of Artificial Sequence: Synthetic oligonucleotide
  Description of Combined DNA/RNA Molecule: Synthetic oligonucleotide
ggguauaagaaaccaccuaugacct

SEQ ID NO: 2694 - DNA, 25 bp, Artificial Sequence
  Description of Artificial Sequence: Synthetic oligonucleotide
  Description of Combined DNA/RNA Molecule: Synthetic oligonucleotide
auauugaaauuccuuuagauagcaa

SEQ ID NO: 2695 - DNA, 25 bp, Artificial Sequence
  Description of Artificial Sequence: Synthetic oligonucleotide
  Description of Combined DNA/RNA Molecule: Synthetic oligonucleotide
aaauuccuuuagauagcaagacutt

SEQ ID NO: 2696 - DNA, 25 bp, Artificial Sequence
  Description of Artificial Sequence: Synthetic oligonucleotide
  Description of Combined DNA/RNA Molecule: Synthetic oligonucleotide
gauaugaaauuuucuuauugugatg

SEQ ID NO: 2697 - DNA, 25 bp, Artificial Sequence
  Description of Artificial Sequence: Synthetic oligonucleotide
  Description of Combined DNA/RNA Molecule: Synthetic oligonucleotide
augaaauuuucuuauugugaugaaa

SEQ ID NO: 2698 - DNA, 25 bp, Artificial Sequence
  Description of Artificial Sequence: Synthetic oligonucleotide
  Description of Combined DNA/RNA Molecule: Synthetic oligonucleotide
ugaaauuuucuuauugugaugaaag

SEQ ID NO: 2699 - DNA, 25 bp, Artificial Sequence
  Description of Artificial Sequence: Synthetic oligonucleotide
  Description of Combined DNA/RNA Molecule: Synthetic oligonucleotide
gaaauuuucuuauugugaugaaaga

SEQ ID NO: 2700 - DNA, 25 bp, Artificial Sequence
  Description of Artificial Sequence: Synthetic oligonucleotide
  Description of Combined DNA/RNA Molecule: Synthetic oligonucleotide
aauuuucuuauugugaugaaagaat

SEQ ID NO: 2701 - DNA, 25 bp, Artificial Sequence
  Description of Artificial Sequence: Synthetic oligonucleotide
  Description of Combined DNA/RNA Molecule: Synthetic oligonucleotide
auuuucuuauugugaugaaagaatt

SEQ ID NO: 2702 - DNA, 25 bp, Artificial Sequence
  Description of Artificial Sequence: Synthetic oligonucleotide
  Description of Combined DNA/RNA Molecule: Synthetic oligonucleotide
uuuucuuauugugaugaaagaauta

SEQ ID NO: 2703 - DNA, 25 bp, Artificial Sequence
  Description of Artificial Sequence: Synthetic oligonucleotide
  Description of Combined DNA/RNA Molecule: Synthetic oligonucleotide
cuuauugugaugaaagaauuaccga

SEQ ID NO: 2704 - DNA, 25 bp, Artificial Sequence
  Description of Artificial Sequence: Synthetic oligonucleotide
  Description of Combined DNA/RNA Molecule: Synthetic oligonucleotide
ugugaugaaagaauuaccgaauuga

SEQ ID NO: 2705 - DNA, 25 bp, Artificial Sequence
  Description of Artificial Sequence: Synthetic oligonucleotide
  Description of Combined DNA/RNA Molecule: Synthetic oligonucleotide
ugaugaaagaauuaccgaauugatg

SEQ ID NO: 2706 - DNA, 25 bp, Artificial Sequence
  Description of Artificial Sequence: Synthetic oligonucleotide
  Description of Combined DNA/RNA Molecule: Synthetic oligonucleotide
aaagaauuaccgaauugaugggata

SEQ ID NO: 2707 - DNA, 25 bp, Artificial Sequence
  Description of Artificial Sequence: Synthetic oligonucleotide
  Description of Combined DNA/RNA Molecule: Synthetic oligonucleotide
aagaauuaccgaauugaugggauat

SEQ ID NO: 2708 - DNA, 25 bp, Artificial Sequence
  Description of Artificial Sequence: Synthetic oligonucleotide
  Description of Combined DNA/RNA Molecule: Synthetic oligonucleotide
agaauuaccgaauugaugggauatg

SEQ ID NO: 2709 - DNA, 25 bp, Artificial Sequence
  Description of Artificial Sequence: Synthetic oligonucleotide
  Description of Combined DNA/RNA Molecule: Synthetic oligonucleotide
gaauuaccgaauugaugggauauga

SEQ ID NO: 2710 - DNA, 25 bp, Artificial Sequence
  Description of Artificial Sequence: Synthetic oligonucleotide
  Description of Combined DNA/RNA Molecule: Synthetic oligonucleotide
augggauaugagccagaagaacutt

SEQ ID NO: 2711 - DNA, 25 bp, Artificial Sequence
  Description of Artificial Sequence: Synthetic oligonucleotide
  Description of Combined DNA/RNA Molecule: Synthetic oligonucleotide
augagccagaagaacuuuuaggccg

SEQ ID NO: 2712 - DNA, 25 bp, Artificial Sequence
  Description of Artificial Sequence: Synthetic oligonucleotide
  Description of Combined DNA/RNA Molecule: Synthetic oligonucleotide
uaggccgcucaauuuaugaauauta

SEQ ID NO: 2713 - DNA, 25 bp, Artificial Sequence
  Description of Artificial Sequence: Synthetic oligonucleotide
  Description of Combined DNA/RNA Molecule: Synthetic oligonucleotide
uaugaauauuaucaugcuuuggact

SEQ ID NO: 2714 - DNA, 25 bp, Artificial Sequence
  Description of Artificial Sequence: Synthetic oligonucleotide
  Description of Combined DNA/RNA Molecule: Synthetic oligonucleotide
ugaauauuaucaugcuuuggacuct

SEQ ID NO: 2715 - DNA, 25 bp, Artificial Sequence
  Description of Artificial Sequence: Synthetic oligonucleotide
  Description of Combined DNA/RNA Molecule: Synthetic oligonucleotide
cugaccaaaacucaucaugauaugt

SEQ ID NO: 2716 - DNA, 25 bp, Artificial Sequence
  Description of Artificial Sequence: Synthetic oligonucleotide
  Description of Combined DNA/RNA Molecule: Synthetic oligonucleotide
caaaacucaucaugauauguuuact

SEQ ID NO: 2717 - DNA, 25 bp, Artificial Sequence
  Description of Artificial Sequence: Synthetic oligonucleotide
  Description of Combined DNA/RNA Molecule: Synthetic oligonucleotide
aaaacucaucaugauauguuuacta

SEQ ID NO: 2718 - DNA, 25 bp, Artificial Sequence
  Description of Artificial Sequence: Synthetic oligonucleotide
  Description of Combined DNA/RNA Molecule: Synthetic oligonucleotide
caugauauguuuacuaaaggacaag

SEQ ID NO: 2719 - DNA, 25 bp, Artificial Sequence
  Description of Artificial Sequence: Synthetic oligonucleotide
  Description of Combined DNA/RNA Molecule: Synthetic oligonucleotide
auauguuuacuaaaggacaagucac

SEQ ID NO: 2720 - DNA, 25 bp, Artificial Sequence
  Description of Artificial Sequence: Synthetic oligonucleotide
  Description of Combined DNA/RNA Molecule: Synthetic oligonucleotide
gguggauaugucuggguugaaactc

SEQ ID NO: 2721 - DNA, 25 bp, Artificial Sequence
  Description of Artificial Sequence: Synthetic oligonucleotide
  Description of Combined DNA/RNA Molecule: Synthetic oligonucleotide
gguugaaacucaagcaacugucata

SEQ ID NO: 2722 - DNA, 25 bp, Artificial Sequence
  Description of Artificial Sequence: Synthetic oligonucleotide
  Description of Combined DNA/RNA Molecule: Synthetic oligonucleotide
cugucauauauaacaccaagaautc

SEQ ID NO: 2723 - DNA, 25 bp, Artificial Sequence
  Description of Artificial Sequence: Synthetic oligonucleotide
  Description of Combined DNA/RNA Molecule: Synthetic oligonucleotide
caagaauucucaaccacagugcatt

SEQ ID NO: 2724 - DNA, 25 bp, Artificial Sequence
  Description of Artificial Sequence: Synthetic oligonucleotide
  Description of Combined DNA/RNA Molecule: Synthetic oligonucleotide
cagugcauuguaugugugaauuacg

SEQ ID NO: 2725 - DNA, 25 bp, Artificial Sequence
  Description of Artificial Sequence: Synthetic oligonucleotide
  Description of Combined DNA/RNA Molecule: Synthetic oligonucleotide
agugcauuguaugugugaauuacgt

SEQ ID NO: 2726 - DNA, 25 bp, Artificial Sequence
  Description of Artificial Sequence: Synthetic oligonucleotide
  Description of Combined DNA/RNA Molecule: Synthetic oligonucleotide
gugugaauuacguugugagugguat

SEQ ID NO: 2727 - DNA, 25 bp, Artificial Sequence
  Description of Artificial Sequence: Synthetic oligonucleotide
  Description of Combined DNA/RNA Molecule: Synthetic oligonucleotide
ugugaauuacguugugagugguatt

SEQ ID NO: 2728 - DNA, 25 bp, Artificial Sequence
  Description of Artificial Sequence: Synthetic oligonucleotide
  Description of Combined DNA/RNA Molecule: Synthetic oligonucleotide
gugaauuacguugugagugguauta

SEQ ID NO: 2729 - DNA, 25 bp, Artificial Sequence
  Description of Artificial Sequence: Synthetic oligonucleotide
  Description of Combined DNA/RNA Molecule: Synthetic oligonucleotide
ugaauuacguugugagugguauuat

SEQ ID NO: 2730 - DNA, 25 bp, Artificial Sequence
  Description of Artificial Sequence: Synthetic oligonucleotide
  Description of Combined DNA/RNA Molecule: Synthetic oligonucleotide
guauuauucagcacgacuugauutt

SEQ ID NO: 2731 - DNA, 25 bp, Artificial Sequence
  Description of Artificial Sequence: Synthetic oligonucleotide
  Description of Combined DNA/RNA Molecule: Synthetic oligonucleotide
ugauuuucucccuucaacaaacaga

SEQ ID NO: 2732 - DNA, 25 bp, Artificial Sequence
  Description of Artificial Sequence: Synthetic oligonucleotide
  Description of Combined DNA/RNA Molecule: Synthetic oligonucleotide
caaacagaauguguccuuaaaccgg

SEQ ID NO: 2733 - DNA, 25 bp, Artificial Sequence
  Description of Artificial Sequence: Synthetic oligonucleotide
  Description of Combined DNA/RNA Molecule: Synthetic oligonucleotide
uguguccuuaaaccgguugaauctt

SEQ ID NO: 2734 - DNA, 25 bp, Artificial Sequence
  Description of Artificial Sequence: Synthetic oligonucleotide
  Description of Combined DNA/RNA Molecule: Synthetic oligonucleotide
cgguugaaucuucagauaugaaaat

SEQ ID NO: 2735 - DNA, 25 bp, Artificial Sequence
  Description of Artificial Sequence: Synthetic oligonucleotide
  Description of Combined DNA/RNA Molecule: Synthetic oligonucleotide
gguugaaucuucagauaugaaaatg

SEQ ID NO: 2736 - DNA, 25 bp, Artificial Sequence
  Description of Artificial Sequence: Synthetic oligonucleotide
  Description of Combined DNA/RNA Molecule: Synthetic oligonucleotide
guugaaucuucagauaugaaaauga

SEQ ID NO: 2737 - DNA, 25 bp, Artificial Sequence
  Description of Artificial Sequence: Synthetic oligonucleotide
  Description of Combined DNA/RNA Molecule: Synthetic oligonucleotide
ugaaucuucagauaugaaaaugact

SEQ ID NO: 2738 - DNA, 25 bp, Artificial Sequence
  Description of Artificial Sequence: Synthetic oligonucleotide
  Description of Combined DNA/RNA Molecule: Synthetic oligonucleotide
gaaucuucagauaugaaaaugactc

SEQ ID NO: 2739 - DNA, 25 bp, Artificial Sequence
  Description of Artificial Sequence: Synthetic oligonucleotide
  Description of Combined DNA/RNA Molecule: Synthetic oligonucleotide
auaugaaaaugacucagcuauucac

SEQ ID NO: 2740 - DNA, 25 bp, Artificial Sequence
  Description of Artificial Sequence: Synthetic oligonucleotide
  Description of Combined DNA/RNA Molecule: Synthetic oligonucleotide
uaugaaaaugacucagcuauucacc

SEQ ID NO: 2741 - DNA, 25 bp, Artificial Sequence
  Description of Artificial Sequence: Synthetic oligonucleotide
  Description of Combined DNA/RNA Molecule: Synthetic oligonucleotide
aguugaaucagaagauacaaguagc

SEQ ID NO: 2742 - DNA, 25 bp, Artificial Sequence
  Description of Artificial Sequence: Synthetic oligonucleotide
  Description of Combined DNA/RNA Molecule: Synthetic oligonucleotide
uugaaucagaagauacaaguagcct

SEQ ID NO: 2743 - DNA, 25 bp, Artificial Sequence
  Description of Artificial Sequence: Synthetic oligonucleotide
  Description of Combined DNA/RNA Molecule: Synthetic oligonucleotide
gaagauacaaguagccucuuugaca

SEQ ID NO: 2744 - DNA, 25 bp, Artificial Sequence
  Description of Artificial Sequence: Synthetic oligonucleotide
  Description of Combined DNA/RNA Molecule: Synthetic oligonucleotide
aagauacaaguagccucuuugacaa

SEQ ID NO: 2745 - DNA, 25 bp, Artificial Sequence
  Description of Artificial Sequence: Synthetic oligonucleotide
  Description of Combined DNA/RNA Molecule: Synthetic oligonucleotide
agauacaaguagccucuuugacaaa

SEQ ID NO: 2746 - DNA, 25 bp, Artificial Sequence
  Description of Artificial Sequence: Synthetic oligonucleotide
  Description of Combined DNA/RNA Molecule: Synthetic oligonucleotide
cuuugacaaacuuaagaaggaacct

SEQ ID NO: 2747 - DNA, 25 bp, Artificial Sequence
  Description of Artificial Sequence: Synthetic oligonucleotide
  Description of Combined DNA/RNA Molecule: Synthetic oligonucleotide
uuugacaaacuuaagaaggaacctg

SEQ ID NO: 2748 - DNA, 25 bp, Artificial Sequence
  Description of Artificial Sequence: Synthetic oligonucleotide
  Description of Combined DNA/RNA Molecule: Synthetic oligonucleotide
cugaugcuuuaacuuugcuggcccc

SEQ ID NO: 2749 - DNA, 25 bp, Artificial Sequence
  Description of Artificial Sequence: Synthetic oligonucleotide
  Description of Combined DNA/RNA Molecule: Synthetic oligonucleotide
ggagacacaaucauaucuuuagatt

SEQ ID NO: 2750 - DNA, 25 bp, Artificial Sequence
  Description of Artificial Sequence: Synthetic oligonucleotide
  Description of Combined DNA/RNA Molecule: Synthetic oligonucleotide
gagacacaaucauaucuuuagautt

SEQ ID NO: 2751 - DNA, 25 bp, Artificial Sequence
  Description of Artificial Sequence: Synthetic oligonucleotide
  Description of Combined DNA/RNA Molecule: Synthetic oligonucleotide
cuugaggaaguaccauuauauaatg

SEQ ID NO: 2752 - DNA, 25 bp, Artificial Sequence
  Description of Artificial Sequence: Synthetic oligonucleotide
  Description of Combined DNA/RNA Molecule: Synthetic oligonucleotide
uugaggaaguaccauuauauaauga

SEQ ID NO: 2753 - DNA, 25 bp, Artificial Sequence
  Description of Artificial Sequence: Synthetic oligonucleotide
  Description of Combined DNA/RNA Molecule: Synthetic oligonucleotide
gaggaaguaccauuauauaaugatg

SEQ ID NO: 2754 - DNA, 25 bp, Artificial Sequence
  Description of Artificial Sequence: Synthetic oligonucleotide
  Description of Combined DNA/RNA Molecule: Synthetic oligonucleotide
aggaaguaccauuauauaaugaugt

SEQ ID NO: 2755 - DNA, 25 bp, Artificial Sequence
  Description of Artificial Sequence: Synthetic oligonucleotide
  Description of Combined DNA/RNA Molecule: Synthetic oligonucleotide
gaaguaccauuauauaaugauguaa

SEQ ID NO: 2756 - DNA, 25 bp, Artificial Sequence
  Description of Artificial Sequence: Synthetic oligonucleotide
  Description of Combined DNA/RNA Molecule: Synthetic oligonucleotide
aaguaccauuauauaaugauguaat

SEQ ID NO: 2757 - DNA, 25 bp, Artificial Sequence
  Description of Artificial Sequence: Synthetic oligonucleotide
  Description of Combined DNA/RNA Molecule: Synthetic oligonucleotide
cgaaaaauuacagaauauaaauutg

SEQ ID NO: 2758 - DNA, 25 bp, Artificial Sequence
  Description of Artificial Sequence: Synthetic oligonucleotide
  Description of Combined DNA/RNA Molecule: Synthetic oligonucleotide
gaaaaauuacagaauauaaauuugg

SEQ ID NO: 2759 - DNA, 25 bp, Artificial Sequence
  Description of Artificial Sequence: Synthetic oligonucleotide
  Description of Combined DNA/RNA Molecule: Synthetic oligonucleotide
aaauuacagaauauaaauuuggcaa

SEQ ID NO: 2760 - DNA, 25 bp, Artificial Sequence
  Description of Artificial Sequence: Synthetic oligonucleotide
  Description of Combined DNA/RNA Molecule: Synthetic oligonucleotide
cagaauauaaauuuggcaauguctc

SEQ ID NO: 2761 - DNA, 25 bp, Artificial Sequence
  Description of Artificial Sequence: Synthetic oligonucleotide
  Description of Combined DNA/RNA Molecule: Synthetic oligonucleotide
agaauauaaauuuggcaaugucucc

SEQ ID NO: 2762 - DNA, 25 bp, Artificial Sequence
  Description of Artificial Sequence: Synthetic oligonucleotide
  Description of Combined DNA/RNA Molecule: Synthetic oligonucleotide
caagaaguugcauuaaaauuagaac

SEQ ID NO: 2763 - DNA, 25 bp, Artificial Sequence
  Description of Artificial Sequence: Synthetic oligonucleotide
  Description of Combined DNA/RNA Molecule: Synthetic oligonucleotide
aagaaguugcauuaaaauuagaacc

SEQ ID NO: 2764 - DNA, 25 bp, Artificial Sequence
  Description of Artificial Sequence: Synthetic oligonucleotide
  Description of Combined DNA/RNA Molecule: Synthetic oligonucleotide
aaauuagaaccaaauccagagucac

SEQ ID NO: 2765 - DNA, 25 bp, Artificial Sequence
  Description of Artificial Sequence: Synthetic oligonucleotide
  Description of Combined DNA/RNA Molecule: Synthetic oligonucleotide
aauuagaaccaaauccagagucact

SEQ ID NO: 2766 - DNA, 25 bp, Artificial Sequence
  Description of Artificial Sequence: Synthetic oligonucleotide
  Description of Combined DNA/RNA Molecule: Synthetic oligonucleotide
agagucacuggaacuuucuuuuacc

SEQ ID NO: 2767 - DNA, 25 bp, Artificial Sequence
  Description of Artificial Sequence: Synthetic oligonucleotide
  Description of Combined DNA/RNA Molecule: Synthetic oligonucleotide
gagucacuggaacuuucuuuuacca

SEQ ID NO: 2768 - DNA, 25 bp, Artificial Sequence
  Description of Artificial Sequence: Synthetic oligonucleotide
  Description of Combined DNA/RNA Molecule: Synthetic oligonucleotide
cuggaacuuucuuuuaccaugcccc

SEQ ID NO: 2769 - DNA, 25 bp, Artificial Sequence
  Description of Artificial Sequence: Synthetic oligonucleotide
  Description of Combined DNA/RNA Molecule: Synthetic oligonucleotide
cuaauagucccagugaauauugutt

SEQ ID NO: 2770 - DNA, 25 bp, Artificial Sequence
  Description of Artificial Sequence: Synthetic oligonucleotide
  Description of Combined DNA/RNA Molecule: Synthetic oligonucleotide
uaauagucccagugaauauuguutt

SEQ ID NO: 2771 - DNA, 25 bp, Artificial Sequence
  Description of Artificial Sequence: Synthetic oligonucleotide
  Description of Combined DNA/RNA Molecule: Synthetic oligonucleotide
aauagucccagugaauauuguuutt

SEQ ID NO: 2772 - DNA, 25 bp, Artificial Sequence
  Description of Artificial Sequence: Synthetic oligonucleotide
  Description of Combined DNA/RNA Molecule: Synthetic oligonucleotide
auagucccagugaauauuguuuuta

SEQ ID NO: 2773 - DNA, 25 bp, Artificial Sequence
  Description of Artificial Sequence: Synthetic oligonucleotide
  Description of Combined DNA/RNA Molecule: Synthetic oligonucleotide
uagucccagugaauauuguuuuuat

SEQ ID NO: 2774 - DNA, 25 bp, Artificial Sequence
  Description of Artificial Sequence: Synthetic oligonucleotide
  Description of Combined DNA/RNA Molecule: Synthetic oligonucleotide
gugaauauuguuuuuauguggauag

SEQ ID NO: 2775 - DNA, 25 bp, Artificial Sequence
  Description of Artificial Sequence: Synthetic oligonucleotide
  Description of Combined DNA/RNA Molecule: Synthetic oligonucleotide
ugaauauuguuuuuauguggauagt

SEQ ID NO: 2776 - DNA, 25 bp, Artificial Sequence
  Description of Artificial Sequence: Synthetic oligonucleotide
  Description of Combined DNA/RNA Molecule: Synthetic oligonucleotide
aauauuguuuuuauguggauaguga

SEQ ID NO: 2777 - DNA, 25 bp, Artificial Sequence
  Description of Artificial Sequence: Synthetic oligonucleotide
  Description of Combined DNA/RNA Molecule: Synthetic oligonucleotide
uauuguuuuuauguggauagugata

SEQ ID NO: 2778 - DNA, 25 bp, Artificial Sequence
  Description of Artificial Sequence: Synthetic oligonucleotide
  Description of Combined DNA/RNA Molecule: Synthetic oligonucleotide
auuguuuuuauguggauagugauat

SEQ ID NO: 2779 - DNA, 25 bp, Artificial Sequence
  Description of Artificial Sequence: Synthetic oligonucleotide
  Description of Combined DNA/RNA Molecule: Synthetic oligonucleotide
uguuuuuauguggauagugauaugg

SEQ ID NO: 2780 - DNA, 25 bp, Artificial Sequence
  Description of Artificial Sequence: Synthetic oligonucleotide
  Description of Combined DNA/RNA Molecule: Synthetic oligonucleotide
uuuuauguggauagugauaugguca

SEQ ID NO: 2781 - DNA, 25 bp, Artificial Sequence
  Description of Artificial Sequence: Synthetic oligonucleotide
  Description of Combined DNA/RNA Molecule: Synthetic oligonucleotide
uggauagugauauggucaaugaatt

SEQ ID NO: 2782 - DNA, 25 bp, Artificial Sequence
  Description of Artificial Sequence: Synthetic oligonucleotide
  Description of Combined DNA/RNA Molecule: Synthetic oligonucleotide
gauagugauauggucaaugaauuca

SEQ ID NO: 2783 - DNA, 25 bp, Artificial Sequence
  Description of Artificial Sequence: Synthetic oligonucleotide
  Description of Combined DNA/RNA Molecule: Synthetic oligonucleotide
auagugauauggucaaugaauucaa

SEQ ID NO: 2784 - DNA, 25 bp, Artificial Sequence
  Description of Artificial Sequence: Synthetic oligonucleotide
  Description of Combined DNA/RNA Molecule: Synthetic oligonucleotide
uagugauauggucaaugaauucaag

SEQ ID NO: 2785 - DNA, 25 bp, Artificial Sequence
  Description of Artificial Sequence: Synthetic oligonucleotide
  Description of Combined DNA/RNA Molecule: Synthetic oligonucleotide
gauauggucaaugaauucaaguugg

SEQ ID NO: 2786 - DNA, 25 bp, Artificial Sequence
  Description of Artificial Sequence: Synthetic oligonucleotide
  Description of Combined DNA/RNA Molecule: Synthetic oligonucleotide
auggucaaugaauucaaguuggaat

SEQ ID NO: 2787 - DNA, 25 bp, Artificial Sequence
  Description of Artificial Sequence: Synthetic oligonucleotide
  Description of Combined DNA/RNA Molecule: Synthetic oligonucleotide
uggucaaugaauucaaguuggaatt

SEQ ID NO: 2788 - DNA, 25 bp, Artificial Sequence
  Description of Artificial Sequence: Synthetic oligonucleotide
  Description of Combined DNA/RNA Molecule: Synthetic oligonucleotide
aaugaauucaaguuggaauugguag

SEQ ID NO: 2789 - DNA, 25 bp, Artificial Sequence
  Description of Artificial Sequence: Synthetic oligonucleotide
  Description of Combined DNA/RNA Molecule: Synthetic oligonucleotide
augaauucaaguuggaauugguaga

SEQ ID NO: 2790 - DNA, 25 bp, Artificial Sequence
  Description of Artificial Sequence: Synthetic oligonucleotide
  Description of Combined DNA/RNA Molecule: Synthetic oligonucleotide
gaauucaaguuggaauugguagaaa

SEQ ID NO: 2791 - DNA, 25 bp, Artificial Sequence
  Description of Artificial Sequence: Synthetic oligonucleotide
  Description of Combined DNA/RNA Molecule: Synthetic oligonucleotide
aaguuggaauugguagaaaaacutt

SEQ ID NO: 2792 - DNA, 25 bp, Artificial Sequence
  Description of Artificial Sequence: Synthetic oligonucleotide
  Description of Combined DNA/RNA Molecule: Synthetic oligonucleotide
gaauugguagaaaaacuuuuugctg

SEQ ID NO: 2793 - DNA, 25 bp, Artificial Sequence
  Description of Artificial Sequence: Synthetic oligonucleotide
  Description of Combined DNA/RNA Molecule: Synthetic oligonucleotide
aauugguagaaaaacuuuuugcuga

SEQ ID NO: 2794 - DNA, 25 bp, Artificial Sequence
  Description of Artificial Sequence: Synthetic oligonucleotide
  Description of Combined DNA/RNA Molecule: Synthetic oligonucleotide
uagaaaaacuuuuugcugaagacac

SEQ ID NO: 2795 - DNA, 25 bp, Artificial Sequence
  Description of Artificial Sequence: Synthetic oligonucleotide
  Description of Combined DNA/RNA Molecule: Synthetic oligonucleotide
agaaaaacuuuuugcugaagacaca

SEQ ID NO: 2796 - DNA, 25 bp, Artificial Sequence
  Description of Artificial Sequence: Synthetic oligonucleotide
  Description of Combined DNA/RNA Molecule: Synthetic oligonucleotide
cuuuuugcugaagacacagaagcaa

SEQ ID NO: 2797 - DNA, 25 bp, Artificial Sequence
  Description of Artificial Sequence: Synthetic oligonucleotide
  Description of Combined DNA/RNA Molecule: Synthetic oligonucleotide
cugaagacacagaagcaaagaaccc

SEQ ID NO: 2798 - DNA, 25 bp, Artificial Sequence
  Description of Artificial Sequence: Synthetic oligonucleotide
  Description of Combined DNA/RNA Molecule: Synthetic oligonucleotide
ugaagacacagaagcaaagaaccca

SEQ ID NO: 2799 - DNA, 25 bp, Artificial Sequence
  Description of Artificial Sequence: Synthetic oligonucleotide
  Description of Combined DNA/RNA Molecule: Synthetic oligonucleotide
cagaagcaaagaacccauuuucuac

SEQ ID NO: 2800 - DNA, 25 bp, Artificial Sequence
  Description of Artificial Sequence: Synthetic oligonucleotide
  Description of Combined DNA/RNA Molecule: Synthetic oligonucleotide
agaacccauuuucuacucaggacac

SEQ ID NO: 2801 - DNA, 25 bp, Artificial Sequence
  Description of Artificial Sequence: Synthetic oligonucleotide
  Description of Combined DNA/RNA Molecule: Synthetic oligonucleotide
caggacacagauuuagacuuggaga

SEQ ID NO: 2802 - DNA, 25 bp, Artificial Sequence
  Description of Artificial Sequence: Synthetic oligonucleotide
  Description of Combined DNA/RNA Molecule: Synthetic oligonucleotide
cagauuuagacuuggagauguuagc

SEQ ID NO: 2803 - DNA, 25 bp, Artificial Sequence
  Description of Artificial Sequence: Synthetic oligonucleotide
  Description of Combined DNA/RNA Molecule: Synthetic oligonucleotide
gauuuagacuuggagauguuagctc

SEQ ID NO: 2804 - DNA, 25 bp, Artificial Sequence
  Description of Artificial Sequence: Synthetic oligonucleotide
  Description of Combined DNA/RNA Molecule: Synthetic oligonucleotide
auuuagacuuggagauguuagcucc

SEQ ID NO: 2805 - DNA, 25 bp, Artificial Sequence
  Description of Artificial Sequence: Synthetic oligonucleotide
  Description of Combined DNA/RNA Molecule: Synthetic oligonucleotide
ggagauguuagcucccuauauccca

SEQ ID NO: 2806 - DNA, 25 bp, Artificial Sequence
  Description of Artificial Sequence: Synthetic oligonucleotide
  Description of Combined DNA/RNA Molecule: Synthetic oligonucleotide
augaugacuuccaguuacguucctt

SEQ ID NO: 2807 - DNA, 25 bp, Artificial Sequence
  Description of Artificial Sequence: Synthetic oligonucleotide
  Description of Combined DNA/RNA Molecule: Synthetic oligonucleotide
cgaucaguugucaccauuagaaagc

SEQ ID NO: 2808 - DNA, 25 bp, Artificial Sequence
  Description of Artificial Sequence: Synthetic oligonucleotide
  Description of Combined DNA/RNA Molecule: Synthetic oligonucleotide
uugucaccauuagaaagcaguuccg

SEQ ID NO: 2809 - DNA, 25 bp, Artificial Sequence
  Description of Artificial Sequence: Synthetic oligonucleotide
  Description of Combined DNA/RNA Molecule: Synthetic oligonucleotide
caguuacaguauuccagcagacuca

SEQ ID NO: 2810 - DNA, 25 bp, Artificial Sequence
  Description of Artificial Sequence: Synthetic oligonucleotide
  Description of Combined DNA/RNA Molecule: Synthetic oligonucleotide
gaauuaaaaacagugacaaaagacc

SEQ ID NO: 2811 - DNA, 25 bp, Artificial Sequence
  Description of Artificial Sequence: Synthetic oligonucleotide
  Description of Combined DNA/RNA Molecule: Synthetic oligonucleotide
aauuaaaaacagugacaaaagaccg

SEQ ID NO: 2812 - DNA, 25 bp, Artificial Sequence
  Description of Artificial Sequence: Synthetic oligonucleotide
  Description of Combined DNA/RNA Molecule: Synthetic oligonucleotide
auuaaaaacagugacaaaagaccgt

SEQ ID NO: 2813 - DNA, 25 bp, Artificial Sequence
  Description of Artificial Sequence: Synthetic oligonucleotide
  Description of Combined DNA/RNA Molecule: Synthetic oligonucleotide
cagugacaaaagaccguauggaaga

SEQ ID NO: 2814 - DNA, 25 bp, Artificial Sequence
  Description of Artificial Sequence: Synthetic oligonucleotide
  Description of Combined DNA/RNA Molecule: Synthetic oligonucleotide
gugacaaaagaccguauggaagaca

SEQ ID NO: 2815 - DNA, 25 bp, Artificial Sequence
  Description of Artificial Sequence: Synthetic oligonucleotide
  Description of Combined DNA/RNA Molecule: Synthetic oligonucleotide
cguauggaagacauuaaaauauuga

SEQ ID NO: 2816 - DNA, 25 bp, Artificial Sequence
  Description of Artificial Sequence: Synthetic oligonucleotide
  Description of Combined DNA/RNA Molecule: Synthetic oligonucleotide
auggaagacauuaaaauauugautg

SEQ ID NO: 2817 - DNA, 25 bp, Artificial Sequence
  Description of Artificial Sequence: Synthetic oligonucleotide
  Description of Combined DNA/RNA Molecule: Synthetic oligonucleotide
uggaagacauuaaaauauugauugc

SEQ ID NO: 2818 - DNA, 25 bp, Artificial Sequence
  Description of Artificial Sequence: Synthetic oligonucleotide
  Description of Combined DNA/RNA Molecule: Synthetic oligonucleotide
gaagacauuaaaauauugauugcat

SEQ ID NO: 2819 - DNA, 25 bp, Artificial Sequence
  Description of Artificial Sequence: Synthetic oligonucleotide
  Description of Combined DNA/RNA Molecule: Synthetic oligonucleotide
auagagauacucaaagucggacagc

SEQ ID NO: 2820 - DNA, 25 bp, Artificial Sequence
  Description of Artificial Sequence: Synthetic oligonucleotide
  Description of Combined DNA/RNA Molecule: Synthetic oligonucleotide
gaaaaggagucauagaacagacaga

SEQ ID NO: 2821 - DNA, 25 bp, Artificial Sequence
  Description of Artificial Sequence: Synthetic oligonucleotide
  Description of Combined DNA/RNA Molecule: Synthetic oligonucleotide
aggagucauagaacagacagaaaaa

SEQ ID NO: 2822 - DNA, 25 bp, Artificial Sequence
  Description of Artificial Sequence: Synthetic oligonucleotide
  Description of Combined DNA/RNA Molecule: Synthetic oligonucleotide
ggagucauagaacagacagaaaaat

SEQ ID NO: 2823 - DNA, 25 bp, Artificial Sequence
  Description of Artificial Sequence: Synthetic oligonucleotide
  Description of Combined DNA/RNA Molecule: Synthetic oligonucleotide
cagaaaaaucucauccaagaagccc

SEQ ID NO: 2824 - DNA, 25 bp, Artificial Sequence
  Description of Artificial Sequence: Synthetic oligonucleotide
  Description of Combined DNA/RNA Molecule: Synthetic oligonucleotide
agaaaaaucucauccaagaagccct

SEQ ID NO: 2825 - DNA, 25 bp, Artificial Sequence
  Description of Artificial Sequence: Synthetic oligonucleotide
  Description of Combined DNA/RNA Molecule: Synthetic oligonucleotide
cguguuaucugucgcuuugagucaa

SEQ ID NO: 2826 - DNA, 25 bp, Artificial Sequence
  Description of Artificial Sequence: Synthetic oligonucleotide
  Description of Combined DNA/RNA Molecule: Synthetic oligonucleotide
guguuaucugucgcuuugagucaaa

SEQ ID NO: 2827 - DNA, 25 bp, Artificial Sequence
  Description of Artificial Sequence: Synthetic oligonucleotide
  Description of Combined DNA/RNA Molecule: Synthetic oligonucleotide
cugucgcuuugagucaaagaacuac

SEQ ID NO: 2828 - DNA, 25 bp, Artificial Sequence
  Description of Artificial Sequence: Synthetic oligonucleotide
  Description of Combined DNA/RNA Molecule: Synthetic oligonucleotide
uuugagucaaagaacuacaguucct

SEQ ID NO: 2829 - DNA, 25 bp, Artificial Sequence
  Description of Artificial Sequence: Synthetic oligonucleotide
  Description of Combined DNA/RNA Molecule: Synthetic oligonucleotide
uugagucaaagaacuacaguucctg

SEQ ID NO: 2830 - DNA, 25 bp, Artificial Sequence
  Description of Artificial Sequence: Synthetic oligonucleotide
  Description of Combined DNA/RNA Molecule: Synthetic oligonucleotide
caaagaacuacaguuccugaggaag

SEQ ID NO: 2831 - DNA, 25 bp, Artificial Sequence
  Description of Artificial Sequence: Synthetic oligonucleotide
  Description of Combined DNA/RNA Molecule: Synthetic oligonucleotide
aaagaacuacaguuccugaggaaga

SEQ ID NO: 2832 - DNA, 25 bp, Artificial Sequence
  Description of Artificial Sequence: Synthetic oligonucleotide
  Description of Combined DNA/RNA Molecule: Synthetic oligonucleotide
gaggaagaacuaaauccaaagauac

SEQ ID NO: 2833 - DNA, 25 bp, Artificial Sequence
  Description of Artificial Sequence: Synthetic oligonucleotide
  Description of Combined DNA/RNA Molecule: Synthetic oligonucleotide
aggaagaacuaaauccaaagauact

SEQ ID NO: 2834 - DNA, 25 bp, Artificial Sequence
  Description of Artificial Sequence: Synthetic oligonucleotide
  Description of Combined DNA/RNA Molecule: Synthetic oligonucleotide
ggaagaacuaaauccaaagauacta

SEQ ID NO: 2835 - DNA, 25 bp, Artificial Sequence
  Description of Artificial Sequence: Synthetic oligonucleotide
  Description of Combined DNA/RNA Molecule: Synthetic oligonucleotide
gaagaacuaaauccaaagauacuag

SEQ ID NO: 2836 - DNA, 25 bp, Artificial Sequence
  Description of Artificial Sequence: Synthetic oligonucleotide
  Description of Combined DNA/RNA Molecule: Synthetic oligonucleotide
aaauccaaagauacuagcuuugcag

SEQ ID NO: 2837 - DNA, 25 bp, Artificial Sequence
  Description of Artificial Sequence: Synthetic oligonucleotide
  Description of Combined DNA/RNA Molecule: Synthetic oligonucleotide
caaagauacuagcuuugcagaaugc

SEQ ID NO: 2838 - DNA, 25 bp, Artificial Sequence
  Description of Artificial Sequence: Synthetic oligonucleotide
  Description of Combined DNA/RNA Molecule: Synthetic oligonucleotide
aagauacuagcuuugcagaaugctc

SEQ ID NO: 2839 - DNA, 25 bp, Artificial Sequence
  Description of Artificial Sequence: Synthetic oligonucleotide
  Description of Combined DNA/RNA Molecule: Synthetic oligonucleotide
agauacuagcuuugcagaaugcuca

SEQ ID NO: 2840 - DNA, 25 bp, Artificial Sequence
  Description of Artificial Sequence: Synthetic oligonucleotide
  Description of Combined DNA/RNA Molecule: Synthetic oligonucleotide
gaaagcgaaaaauggaacaugaugg

SEQ ID NO: 2841 - DNA, 25 bp, Artificial Sequence
  Description of Artificial Sequence: Synthetic oligonucleotide
  Description of Combined DNA/RNA Molecule: Synthetic oligonucleotide
uggaacaugaugguucacuuuuuca

SEQ ID NO: 2842 - DNA, 25 bp, Artificial Sequence
  Description of Artificial Sequence: Synthetic oligonucleotide
  Description of Combined DNA/RNA Molecule: Synthetic oligonucleotide
augaugguucacuuuuucaagcagt

SEQ ID NO: 2843 - DNA, 25 bp, Artificial Sequence
  Description of Artificial Sequence: Synthetic oligonucleotide
  Description of Combined DNA/RNA Molecule: Synthetic oligonucleotide
uuuuucaagcaguaggaauuggaac

SEQ ID NO: 2844 - DNA, 25 bp, Artificial Sequence
  Description of Artificial Sequence: Synthetic oligonucleotide
  Description of Combined DNA/RNA Molecule: Synthetic oligonucleotide
caguaggaauuggaacauuauuaca

SEQ ID NO: 2845 - DNA, 25 bp, Artificial Sequence
  Description of Artificial Sequence: Synthetic oligonucleotide
  Description of Combined DNA/RNA Molecule: Synthetic oligonucleotide
aguaggaauuggaacauuauuacag

SEQ ID NO: 2846 - DNA, 25 bp, Artificial Sequence
  Description of Artificial Sequence: Synthetic oligonucleotide
  Description of Combined DNA/RNA Molecule: Synthetic oligonucleotide
guaggaauuggaacauuauuacagc

SEQ ID NO: 2847 - DNA, 25 bp, Artificial Sequence
  Description of Artificial Sequence: Synthetic oligonucleotide
  Description of Combined DNA/RNA Molecule: Synthetic oligonucleotide
cuuggaaacguguaaaaggaugcaa

SEQ ID NO: 2848 - DNA, 25 bp, Artificial Sequence
  Description of Artificial Sequence: Synthetic oligonucleotide
  Description of Combined DNA/RNA Molecule: Synthetic oligonucleotide
uuggaaacguguaaaaggaugcaaa

SEQ ID NO: 2849 - DNA, 25 bp, Artificial Sequence
  Description of Artificial Sequence: Synthetic oligonucleotide
  Description of Combined DNA/RNA Molecule: Synthetic oligonucleotide
uaaaaggaugcaaaucuagugaaca

SEQ ID NO: 2850 - DNA, 25 bp, Artificial Sequence
  Description of Artificial Sequence: Synthetic oligonucleotide
  Description of Combined DNA/RNA Molecule: Synthetic oligonucleotide
aaaaggaugcaaaucuagugaacag

SEQ ID NO: 2851 - DNA, 25 bp, Artificial Sequence
  Description of Artificial Sequence: Synthetic oligonucleotide
  Description of Combined DNA/RNA Molecule: Synthetic oligonucleotide
gaugcaaaucuagugaacagaaugg

SEQ ID NO: 2852 - DNA, 25 bp, Artificial Sequence
  Description of Artificial Sequence: Synthetic oligonucleotide
  Description of Combined DNA/RNA Molecule: Synthetic oligonucleotide
caaaucuagugaacagaauggaatg

SEQ ID NO: 2853 - DNA, 25 bp, Artificial Sequence
  Description of Artificial Sequence: Synthetic oligonucleotide
  Description of Combined DNA/RNA Molecule: Synthetic oligonucleotide
uagugaacagaauggaauggagcaa

SEQ ID NO: 2854 - DNA, 25 bp, Artificial Sequence
  Description of Artificial Sequence: Synthetic oligonucleotide
  Description of Combined DNA/RNA Molecule: Synthetic oligonucleotide
agugaacagaauggaauggagcaaa

SEQ ID NO: 2855 - DNA, 25 bp, Artificial Sequence
  Description of Artificial Sequence: Synthetic oligonucleotide
  Description of Combined DNA/RNA Molecule: Synthetic oligonucleotide
agaauggaauggagcaaaagacaat

SEQ ID NO: 2856 - DNA, 25 bp, Artificial Sequence
  Description of Artificial Sequence: Synthetic oligonucleotide
  Description of Combined DNA/RNA Molecule: Synthetic oligonucleotide
ggaauggagcaaaagacaauuautt

SEQ ID NO: 2857 - DNA, 25 bp, Artificial Sequence
  Description of Artificial Sequence: Synthetic oligonucleotide
  Description of Combined DNA/RNA Molecule: Synthetic oligonucleotide
aauggagcaaaagacaauuauuuta

SEQ ID NO: 2858 - DNA, 25 bp, Artificial Sequence
  Description of Artificial Sequence: Synthetic oligonucleotide
  Description of Combined DNA/RNA Molecule: Synthetic oligonucleotide
auggagcaaaagacaauuauuuuaa

SEQ ID NO: 2859 - DNA, 25 bp, Artificial Sequence
  Description of Artificial Sequence: Synthetic oligonucleotide
  Description of Combined DNA/RNA Molecule: Synthetic oligonucleotide
uggagcaaaagacaauuauuuuaat

SEQ ID NO: 2860 - DNA, 25 bp, Artificial Sequence
  Description of Artificial Sequence: Synthetic oligonucleotide
  Description of Combined DNA/RNA Molecule: Synthetic oligonucleotide
ggagcaaaagacaauuauuuuaata

SEQ ID NO: 2861 - DNA, 25 bp, Artificial Sequence
  Description of Artificial Sequence: Synthetic oligonucleotide
  Description of Combined DNA/RNA Molecule: Synthetic oligonucleotide
aauuauuuuaauacccucugauuta

SEQ ID NO: 2862 - DNA, 25 bp, Artificial Sequence
  Description of Artificial Sequence: Synthetic oligonucleotide
  Description of Combined DNA/RNA Molecule: Synthetic oligonucleotide
auuauuuuaauacccucugauuuag

SEQ ID NO: 2863 - DNA, 25 bp, Artificial Sequence
  Description of Artificial Sequence: Synthetic oligonucleotide
  Description of Combined DNA/RNA Molecule: Synthetic oligonucleotide
uuauuuuaauacccucugauuuagc

SEQ ID NO: 2864 - DNA, 25 bp, Artificial Sequence
  Description of Artificial Sequence: Synthetic oligonucleotide
  Description of Combined DNA/RNA Molecule: Synthetic oligonucleotide
auuuuaauacccucugauuuagcat

SEQ ID NO: 2865 - DNA, 25 bp, Artificial Sequence
  Description of Artificial Sequence: Synthetic oligonucleotide
  Description of Combined DNA/RNA Molecule: Synthetic oligonucleotide
uuuuaauacccucugauuuagcatg

SEQ ID NO: 2866 - DNA, 25 bp, Artificial Sequence
  Description of Artificial Sequence: Synthetic oligonucleotide
  Description of Combined DNA/RNA Molecule: Synthetic oligonucleotide
uggggcaaucaauggaugaaagugg

SEQ ID NO: 2867 - DNA, 25 bp, Artificial Sequence
  Description of Artificial Sequence: Synthetic oligonucleotide
  Description of Combined DNA/RNA Molecule: Synthetic oligonucleotide
caaucaauggaugaaaguggauuac

SEQ ID NO: 2868 - DNA, 25 bp, Artificial Sequence
  Description of Artificial Sequence: Synthetic oligonucleotide
  Description of Combined DNA/RNA Molecule: Synthetic oligonucleotide
aguuaugauugugaaguuaaugctc

SEQ ID NO: 2869 - DNA, 25 bp, Artificial Sequence
  Description of Artificial Sequence: Synthetic oligonucleotide
  Description of Combined DNA/RNA Molecule: Synthetic oligonucleotide
guuaugauugugaaguuaaugcucc

SEQ ID NO: 2870 - DNA, 25 bp, Artificial Sequence
  Description of Artificial Sequence: Synthetic oligonucleotide
  Description of Combined DNA/RNA Molecule: Synthetic oligonucleotide
ugugaaguuaaugcuccuauacaag

SEQ ID NO: 2871 - DNA, 25 bp, Artificial Sequence
  Description of Artificial Sequence: Synthetic oligonucleotide
  Description of Combined DNA/RNA Molecule: Synthetic oligonucleotide
aaguuaaugcuccuauacaaggcag

SEQ ID NO: 2872 - DNA, 25 bp, Artificial Sequence
  Description of Artificial Sequence: Synthetic oligonucleotide
  Description of Combined DNA/RNA Molecule: Synthetic oligonucleotide
agggugaagaauuacucagagcutt

SEQ ID NO: 2873 - DNA, 25 bp, Artificial Sequence
  Description of Artificial Sequence: Synthetic oligonucleotide
  Description of Combined DNA/RNA Molecule: Synthetic oligonucleotide
aagaauuacucagagcuuuggauca

SEQ ID NO: 2874 - DNA, 25 bp, Artificial Sequence
  Description of Artificial Sequence: Synthetic oligonucleotide
  Description of Combined DNA/RNA Molecule: Synthetic oligonucleotide
gaauuacucagagcuuuggaucaag

SEQ ID NO: 2875 - DNA, 25 bp, Artificial Sequence
  Description of Artificial Sequence: Synthetic oligonucleotide
  Description of Combined DNA/RNA Molecule: Synthetic oligonucleotide
cagagcuuuggaucaaguuaacuga

SEQ ID NO: 2876 - DNA, 25 bp, Artificial Sequence
  Description of Artificial Sequence: Synthetic oligonucleotide
  Description of Combined DNA/RNA Molecule: Synthetic oligonucleotide
aguuaacugagcuuuuucuuaautt

SEQ ID NO: 2877 - DNA, 25 bp, Artificial Sequence
  Description of Artificial Sequence: Synthetic oligonucleotide
  Description of Combined DNA/RNA Molecule: Synthetic oligonucleotide
uuaacugagcuuuuucuuaauuuca

SEQ ID NO: 2878 - DNA, 25 bp, Artificial Sequence
  Description of Artificial Sequence: Synthetic oligonucleotide
  Description of Combined DNA/RNA Molecule: Synthetic oligonucleotide
uuuucuuaauuucauuccuuuuutt

SEQ ID NO: 2879 - DNA, 25 bp, Artificial Sequence
  Description of Artificial Sequence: Synthetic oligonucleotide
  Description of Combined DNA/RNA Molecule: Synthetic oligonucleotide
uuaauuucauuccuuuuuuuggaca

SEQ ID NO: 2880 - DNA, 25 bp, Artificial Sequence
  Description of Artificial Sequence: Synthetic oligonucleotide
  Description of Combined DNA/RNA Molecule: Synthetic oligonucleotide
aauuucauuccuuuuuuuggacact

SEQ ID NO: 2881 - DNA, 25 bp, Artificial Sequence
  Description of Artificial Sequence: Synthetic oligonucleotide
  Description of Combined DNA/RNA Molecule: Synthetic oligonucleotide
cugguggcucauuaccuaaagcagt

SEQ ID NO: 2882 - DNA, 25 bp, Artificial Sequence
  Description of Artificial Sequence: Synthetic oligonucleotide
  Description of Combined DNA/RNA Molecule: Synthetic oligonucleotide
cauuaccuaaagcagucuauuuata

SEQ ID NO: 2883 - DNA, 25 bp, Artificial Sequence
  Description of Artificial Sequence: Synthetic oligonucleotide
  Description of Combined DNA/RNA Molecule: Synthetic oligonucleotide
auuaccuaaagcagucuauuuauat

SEQ ID NO: 2884 - DNA, 25 bp, Artificial Sequence
  Description of Artificial Sequence: Synthetic oligonucleotide
  Description of Combined DNA/RNA Molecule: Synthetic oligonucleotide
cuaaagcagucuauuuauauuuuct

SEQ ID NO: 2885 - DNA, 25 bp, Artificial Sequence
  Description of Artificial Sequence: Synthetic oligonucleotide
  Description of Combined DNA/RNA Molecule: Synthetic oligonucleotide
aaagcagucuauuuauauuuucuac

SEQ ID NO: 2886 - DNA, 25 bp, Artificial Sequence
  Description of Artificial Sequence: Synthetic oligonucleotide
  Description of Combined DNA/RNA Molecule: Synthetic oligonucleotide
uuuauauuuucuacaucuaauuuta

SEQ ID NO: 2887 - DNA, 25 bp, Artificial Sequence
  Description of Artificial Sequence: Synthetic oligonucleotide
  Description of Combined DNA/RNA Molecule: Synthetic oligonucleotide
uuauauuuucuacaucuaauuuuag

SEQ ID NO: 2888 - DNA, 25 bp, Artificial Sequence
  Description of Artificial Sequence: Synthetic oligonucleotide
  Description of Combined DNA/RNA Molecule: Synthetic oligonucleotide
uauauuuucuacaucuaauuuuaga

SEQ ID NO: 2889 - DNA, 25 bp, Artificial Sequence
  Description of Artificial Sequence: Synthetic oligonucleotide
  Description of Combined DNA/RNA Molecule: Synthetic oligonucleotide
uauuuucuacaucuaauuuuagaag

SEQ ID NO: 2890 - DNA, 25 bp, Artificial Sequence
  Description of Artificial Sequence: Synthetic oligonucleotide
  Description of Combined DNA/RNA Molecule: Synthetic oligonucleotide
auuuucuacaucuaauuuuagaagc

SEQ ID NO: 2891 - DNA, 25 bp, Artificial Sequence
  Description of Artificial Sequence: Synthetic oligonucleotide
  Description of Combined DNA/RNA Molecule: Synthetic oligonucleotide
cuggcuacaauacugcacaaacutg

SEQ ID NO: 2892 - DNA, 25 bp, Artificial Sequence
  Description of Artificial Sequence: Synthetic oligonucleotide
  Description of Combined DNA/RNA Molecule: Synthetic oligonucleotide
cuugguuaguucaauuuugaucccc

SEQ ID NO: 2893 - DNA, 25 bp, Artificial Sequence
  Description of Artificial Sequence: Synthetic oligonucleotide
  Description of Combined DNA/RNA Molecule: Synthetic oligonucleotide
aguucaauuuugauccccuuucuac

SEQ ID NO: 2894 - DNA, 25 bp, Artificial Sequence
  Description of Artificial Sequence: Synthetic oligonucleotide
  Description of Combined DNA/RNA Molecule: Synthetic oligonucleotide
uuugauccccuuucuacuuaauuta

SEQ ID NO: 2895 - DNA, 25 bp, Artificial Sequence
  Description of Artificial Sequence: Synthetic oligonucleotide
  Description of Combined DNA/RNA Molecule: Synthetic oligonucleotide
uugauccccuuucuacuuaauuuac

SEQ ID NO: 2896 - DNA, 25 bp, Artificial Sequence
  Description of Artificial Sequence: Synthetic oligonucleotide
  Description of Combined DNA/RNA Molecule: Synthetic oligonucleotide
ugauccccuuucuacuuaauuuaca

SEQ ID NO: 2897 - DNA, 25 bp, Artificial Sequence
  Description of Artificial Sequence: Synthetic oligonucleotide
  Description of Combined DNA/RNA Molecule: Synthetic oligonucleotide
cuuucuacuuaauuuacauuaaugc

SEQ ID NO: 2898 - DNA, 25 bp, Artificial Sequence
  Description of Artificial Sequence: Synthetic oligonucleotide
  Description of Combined DNA/RNA Molecule: Synthetic oligonucleotide
aauuuacauuaaugcucuuuuuuag

SEQ ID NO: 2899 - DNA, 25 bp, Artificial Sequence
  Description of Artificial Sequence: Synthetic oligonucleotide
  Description of Combined DNA/RNA Molecule: Synthetic oligonucleotide
auuuacauuaaugcucuuuuuuagt

SEQ ID NO: 2900 - DNA, 25 bp, Artificial Sequence
  Description of Artificial Sequence: Synthetic oligonucleotide
  Description of Combined DNA/RNA Molecule: Synthetic oligonucleotide
auuaaugcucuuuuuuaguaugutc

SEQ ID NO: 2901 - DNA, 25 bp, Artificial Sequence
  Description of Artificial Sequence: Synthetic oligonucleotide
  Description of Combined DNA/RNA Molecule: Synthetic oligonucleotide
uuaaugcucuuuuuuaguauguuct

SEQ ID NO: 2902 - DNA, 25 bp, Artificial Sequence
  Description of Artificial Sequence: Synthetic oligonucleotide
  Description of Combined DNA/RNA Molecule: Synthetic oligonucleotide
aaugcucuuuuuuaguauguucutt

SEQ ID NO: 2903 - DNA, 25 bp, Artificial Sequence
  Description of Artificial Sequence: Synthetic oligonucleotide
  Description of Combined DNA/RNA Molecule: Synthetic oligonucleotide
uuuuuaguauguucuuuaaugcugg

SEQ ID NO: 2904 - DNA, 25 bp, Artificial Sequence
  Description of Artificial Sequence: Synthetic oligonucleotide
  Description of Combined DNA/RNA Molecule: Synthetic oligonucleotide
uaguauguucuuuaaugcuggauca

SEQ ID NO: 2905 - DNA, 25 bp, Artificial Sequence
  Description of Artificial Sequence: Synthetic oligonucleotide
  Description of Combined DNA/RNA Molecule: Synthetic oligonucleotide
aguauguucuuuaaugcuggaucac

SEQ ID NO: 2906 - DNA, 25 bp, Artificial Sequence
  Description of Artificial Sequence: Synthetic oligonucleotide
  Description of Combined DNA/RNA Molecule: Synthetic oligonucleotide
guauguucuuuaaugcuggaucaca

SEQ ID NO: 2907 - DNA, 25 bp, Artificial Sequence
  Description of Artificial Sequence: Synthetic oligonucleotide
  Description of Combined DNA/RNA Molecule: Synthetic oligonucleotide
cagacagcucauuuucucaguuutt

SEQ ID NO: 2908 - DNA, 25 bp, Artificial Sequence
  Description of Artificial Sequence: Synthetic oligonucleotide
  Description of Combined DNA/RNA Molecule: Synthetic oligonucleotide
cauuuucucaguuuuuugguauuta

SEQ ID NO: 2909 - DNA, 25 bp, Artificial Sequence
  Description of Artificial Sequence: Synthetic oligonucleotide
  Description of Combined DNA/RNA Molecule: Synthetic oligonucleotide
auuuucucaguuuuuugguauuuaa

SEQ ID NO: 2910 - DNA, 25 bp, Artificial Sequence
  Description of Artificial Sequence: Synthetic oligonucleotide
  Description of Combined DNA/RNA Molecule: Synthetic oligonucleotide
uuuucucaguuuuuugguauuuaaa

SEQ ID NO: 2911 - DNA, 25 bp, Artificial Sequence
  Description of Artificial Sequence: Synthetic oligonucleotide
  Description of Combined DNA/RNA Molecule: Synthetic oligonucleotide
uuuuugguauuuaaaccauugcatt

SEQ ID NO: 2912 - DNA, 25 bp, Artificial Sequence
  Description of Artificial Sequence: Synthetic oligonucleotide
  Description of Combined DNA/RNA Molecule: Synthetic oligonucleotide
ugguauuuaaaccauugcauugcag

SEQ ID NO: 2913 - DNA, 25 bp, Artificial Sequence
  Description of Artificial Sequence: Synthetic oligonucleotide
  Description of Combined DNA/RNA Molecule: Synthetic oligonucleotide
gguauuuaaaccauugcauugcagt

SEQ ID NO: 2914 - DNA, 25 bp, Artificial Sequence
  Description of Artificial Sequence: Synthetic oligonucleotide
  Description of Combined DNA/RNA Molecule: Synthetic oligonucleotide
uuaaaccauugcauugcaguagcat

SEQ ID NO: 2915 - DNA, 25 bp, Artificial Sequence
  Description of Artificial Sequence: Synthetic oligonucleotide
  Description of Combined DNA/RNA Molecule: Synthetic oligonucleotide
auugcaguagcaucauuuuaaaaaa

SEQ ID NO: 2916 - DNA, 25 bp, Artificial Sequence
  Description of Artificial Sequence: Synthetic oligonucleotide
  Description of Combined DNA/RNA Molecule: Synthetic oligonucleotide
aguagcaucauuuuaaaaaaugcac

SEQ ID NO: 2917 - DNA, 25 bp, Artificial Sequence
  Description of Artificial Sequence: Synthetic oligonucleotide
  Description of Combined DNA/RNA Molecule: Synthetic oligonucleotide
guagcaucauuuuaaaaaaugcacc

SEQ ID NO: 2918 - DNA, 25 bp, Artificial Sequence
  Description of Artificial Sequence: Synthetic oligonucleotide
  Description of Combined DNA/RNA Molecule: Synthetic oligonucleotide
cauuuuaaaaaaugcaccuuuuuat

SEQ ID NO: 2919 - DNA, 25 bp, Artificial Sequence
  Description of Artificial Sequence: Synthetic oligonucleotide
  Description of Combined DNA/RNA Molecule: Synthetic oligonucleotide
auuuuaaaaaaugcaccuuuuuatt

SEQ ID NO: 2920 - DNA, 25 bp, Artificial Sequence
  Description of Artificial Sequence: Synthetic oligonucleotide
  Description of Combined DNA/RNA Molecule: Synthetic oligonucleotide
uuuuaaaaaaugcaccuuuuuautt

SEQ ID NO: 2921 - DNA, 25 bp, Artificial Sequence
  Description of Artificial Sequence: Synthetic oligonucleotide
  Description of Combined DNA/RNA Molecule: Synthetic oligonucleotide
uuuaaaaaaugcaccuuuuuauuta

SEQ ID NO: 2922 - DNA, 25 bp, Artificial Sequence
  Description of Artificial Sequence: Synthetic oligonucleotide
  Description of Combined DNA/RNA Molecule: Synthetic oligonucleotide
uuaaaaaaugcaccuuuuuauuuat

SEQ ID NO: 2923 - DNA, 25 bp, Artificial Sequence
  Description of Artificial Sequence: Synthetic oligonucleotide
  Description of Combined DNA/RNA Molecule: Synthetic oligonucleotide
uaaaaaaugcaccuuuuuauuuatt

SEQ ID NO: 2924 - DNA, 25 bp, Artificial Sequence
  Description of Artificial Sequence: Synthetic oligonucleotide
  Description of Combined DNA/RNA Molecule: Synthetic oligonucleotide
aaaaaugcaccuuuuuauuuauuta

SEQ ID NO: 2925 - DNA, 25 bp, Artificial Sequence
  Description of Artificial Sequence: Synthetic oligonucleotide
  Description of Combined DNA/RNA Molecule: Synthetic oligonucleotide
aaaugcaccuuuuuauuuauuuatt

SEQ ID NO: 2926 - DNA, 25 bp, Artificial Sequence
  Description of Artificial Sequence: Synthetic oligonucleotide
  Description of Combined DNA/RNA Molecule: Synthetic oligonucleotide
cuuuuuauuuauuuauuuuuggcta

SEQ ID NO: 2927 - DNA, 25 bp, Artificial Sequence
  Description of Artificial Sequence: Synthetic oligonucleotide
  Description of Combined DNA/RNA Molecule: Synthetic oligonucleotide
auuuauuuauuuuuggcuagggagt

SEQ ID NO: 2928 - DNA, 25 bp, Artificial Sequence
  Description of Artificial Sequence: Synthetic oligonucleotide
  Description of Combined DNA/RNA Molecule: Synthetic oligonucleotide
uuauuuauuuuuggcuagggagutt

SEQ ID NO: 2929 - DNA, 25 bp, Artificial Sequence
  Description of Artificial Sequence: Synthetic oligonucleotide
  Description of Combined DNA/RNA Molecule: Synthetic oligonucleotide
uauuuauuuuuggcuagggaguuta

SEQ ID NO: 2930 - DNA, 25 bp, Artificial Sequence
  Description of Artificial Sequence: Synthetic oligonucleotide
  Description of Combined DNA/RNA Molecule: Synthetic oligonucleotide
auuuauuuuuggcuagggaguuuat

SEQ ID NO: 2931 - DNA, 25 bp, Artificial Sequence
  Description of Artificial Sequence: Synthetic oligonucleotide
  Description of Combined DNA/RNA Molecule: Synthetic oligonucleotide
uuuauuuuuggcuagggaguuuatc

SEQ ID NO: 2932 - DNA, 25 bp, Artificial Sequence
  Description of Artificial Sequence: Synthetic oligonucleotide
  Description of Combined DNA/RNA Molecule: Synthetic oligonucleotide
ggaguuuaucccuuuuucgaauuat

SEQ ID NO: 2933 - DNA, 25 bp, Artificial Sequence
  Description of Artificial Sequence: Synthetic oligonucleotide
  Description of Combined DNA/RNA Molecule: Synthetic oligonucleotide
gaguuuaucccuuuuucgaauuatt

SEQ ID NO: 2934 - DNA, 25 bp, Artificial Sequence
  Description of Artificial Sequence: Synthetic oligonucleotide
  Description of Combined DNA/RNA Molecule: Synthetic oligonucleotide
aguuuaucccuuuuucgaauuautt

SEQ ID NO: 2935 - DNA, 25 bp, Artificial Sequence
  Description of Artificial Sequence: Synthetic oligonucleotide
  Description of Combined DNA/RNA Molecule: Synthetic oligonucleotide
guuuaucccuuuuucgaauuauutt

SEQ ID NO: 2936 - DNA, 25 bp, Artificial Sequence
  Description of Artificial Sequence: Synthetic oligonucleotide
  Description of Combined DNA/RNA Molecule: Synthetic oligonucleotide
uuuaucccuuuuucgaauuauuutt

SEQ ID NO: 2937 - DNA, 25 bp, Artificial Sequence
  Description of Artificial Sequence: Synthetic oligonucleotide
  Description of Combined DNA/RNA Molecule: Synthetic oligonucleotide
uuaucccuuuuucgaauuauuuuta

SEQ ID NO: 2938 - DNA, 25 bp, Artificial Sequence
  Description of Artificial Sequence: Synthetic oligonucleotide
  Description of Combined DNA/RNA Molecule: Synthetic oligonucleotide
cgaauuauuuuuaagaagaugccaa

SEQ ID NO: 2939 - DNA, 25 bp, Artificial Sequence
  Description of Artificial Sequence: Synthetic oligonucleotide
  Description of Combined DNA/RNA Molecule: Synthetic oligonucleotide
uauuuuuaagaagaugccaauauaa

SEQ ID NO: 2940 - DNA, 25 bp, Artificial Sequence
  Description of Artificial Sequence: Synthetic oligonucleotide
  Description of Combined DNA/RNA Molecule: Synthetic oligonucleotide
auuuuuaagaagaugccaauauaat

SEQ ID NO: 2941 - DNA, 25 bp, Artificial Sequence
  Description of Artificial Sequence: Synthetic oligonucleotide
  Description of Combined DNA/RNA Molecule: Synthetic oligonucleotide
uuuuaagaagaugccaauauaautt

SEQ ID NO: 2942 - DNA, 25 bp, Artificial Sequence
  Description of Artificial Sequence: Synthetic oligonucleotide
  Description of Combined DNA/RNA Molecule: Synthetic oligonucleotide
uuuaagaagaugccaauauaauutt

SEQ ID NO: 2943 - DNA, 25 bp, Artificial Sequence
  Description of Artificial Sequence: Synthetic oligonucleotide
  Description of Combined DNA/RNA Molecule: Synthetic oligonucleotide
uaagaagaugccaauauaauuuutg

SEQ ID NO: 2944 - DNA, 25 bp, Artificial Sequence
  Description of Artificial Sequence: Synthetic oligonucleotide
  Description of Combined DNA/RNA Molecule: Synthetic oligonucleotide
aagaagaugccaauauaauuuuugt

SEQ ID NO: 2945 - DNA, 25 bp, Artificial Sequence
  Description of Artificial Sequence: Synthetic oligonucleotide
  Description of Combined DNA/RNA Molecule: Synthetic oligonucleotide
gaagaugccaauauaauuuuuguaa

SEQ ID NO: 2946 - DNA, 25 bp, Artificial Sequence
  Description of Artificial Sequence: Synthetic oligonucleotide
  Description of Combined DNA/RNA Molecule: Synthetic oligonucleotide
aagaugccaauauaauuuuuguaag

SEQ ID NO: 2947 - DNA, 25 bp, Artificial Sequence
  Description of Artificial Sequence: Synthetic oligonucleotide
  Description of Combined DNA/RNA Molecule: Synthetic oligonucleotide
agaugccaauauaauuuuuguaaga

SEQ ID NO: 2948 - DNA, 25 bp, Artificial Sequence
  Description of Artificial Sequence: Synthetic oligonucleotide
  Description of Combined DNA/RNA Molecule: Synthetic oligonucleotide
aauauaauuuuuguaagaaggcagt

SEQ ID NO: 2949 - DNA, 25 bp, Artificial Sequence
  Description of Artificial Sequence: Synthetic oligonucleotide
  Description of Combined DNA/RNA Molecule: Synthetic oligonucleotide
uaauuuuuguaagaaggcaguaacc

SEQ ID NO: 2950 - DNA, 25 bp, Artificial Sequence
  Description of Artificial Sequence: Synthetic oligonucleotide
  Description of Combined DNA/RNA Molecule: Synthetic oligonucleotide
auuuuuguaagaaggcaguaacctt

SEQ ID NO: 2951 - DNA, 25 bp, Artificial Sequence
  Description of Artificial Sequence: Synthetic oligonucleotide
  Description of Combined DNA/RNA Molecule: Synthetic oligonucleotide
caugaucauaggcaguugaaaaatt

SEQ ID NO: 2952 - DNA, 25 bp, Artificial Sequence
  Description of Artificial Sequence: Synthetic oligonucleotide
  Description of Combined DNA/RNA Molecule: Synthetic oligonucleotide
ugaucauaggcaguugaaaaauutt

SEQ ID NO: 2953 - DNA, 25 bp, Artificial Sequence
  Description of Artificial Sequence: Synthetic oligonucleotide
  Description of Combined DNA/RNA Molecule: Synthetic oligonucleotide
cauaggcaguugaaaaauuuuuaca

SEQ ID NO: 2954 - DNA, 25 bp, Artificial Sequence
  Description of Artificial Sequence: Synthetic oligonucleotide
  Description of Combined DNA/RNA Molecule: Synthetic oligonucleotide
uaggcaguugaaaaauuuuuacacc

SEQ ID NO: 2955 - DNA, 25 bp, Artificial Sequence
  Description of Artificial Sequence: Synthetic oligonucleotide
  Description of Combined DNA/RNA Molecule: Synthetic oligonucleotide
ugaaaaauuuuuacaccuuuuuutt

SEQ ID NO: 2956 - DNA, 25 bp, Artificial Sequence
  Description of Artificial Sequence: Synthetic oligonucleotide
  Description of Combined DNA/RNA Molecule: Synthetic oligonucleotide
gaaaaauuuuuacaccuuuuuuutc

SEQ ID NO: 2957 - DNA, 25 bp, Artificial Sequence
  Description of Artificial Sequence: Synthetic oligonucleotide
  Description of Combined DNA/RNA Molecule: Synthetic oligonucleotide
aaaaauuuuuacaccuuuuuuuuca

SEQ ID NO: 2958 - DNA, 25 bp, Artificial Sequence
  Description of Artificial Sequence: Synthetic oligonucleotide
  Description of Combined DNA/RNA Molecule: Synthetic oligonucleotide
aaaauuuuuacaccuuuuuuuucac

SEQ ID NO: 2959 - DNA, 25 bp, Artificial Sequence
  Description of Artificial Sequence: Synthetic oligonucleotide
  Description of Combined DNA/RNA Molecule: Synthetic oligonucleotide
aaauuuuuacaccuuuuuuuucaca

SEQ ID NO: 2960 - DNA, 25 bp, Artificial Sequence
  Description of Artificial Sequence: Synthetic oligonucleotide
  Description of Combined DNA/RNA Molecule: Synthetic oligonucleotide
uuuuuuucacauuuuacauaaauaa

SEQ ID NO: 2961 - DNA, 25 bp, Artificial Sequence
  Description of Artificial Sequence: Synthetic oligonucleotide
  Description of Combined DNA/RNA Molecule: Synthetic oligonucleotide
uuuuuucacauuuuacauaaauaat

SEQ ID NO: 2962 - DNA, 25 bp, Artificial Sequence
  Description of Artificial Sequence: Synthetic oligonucleotide
  Description of Combined DNA/RNA Molecule: Synthetic oligonucleotide
uuuuucacauuuuacauaaauaata

SEQ ID NO: 2963 - DNA, 25 bp, Artificial Sequence
  Description of Artificial Sequence: Synthetic oligonucleotide
  Description of Combined DNA/RNA Molecule: Synthetic oligonucleotide
uuuucacauuuuacauaaauaauaa

SEQ ID NO: 2964 - DNA, 25 bp, Artificial Sequence
  Description of Artificial Sequence: Synthetic oligonucleotide
  Description of Combined DNA/RNA Molecule: Synthetic oligonucleotide
cauuuuacauaaauaauaaugcutt

SEQ ID NO: 2965 - DNA, 25 bp, Artificial Sequence
  Description of Artificial Sequence: Synthetic oligonucleotide
  Description of Combined DNA/RNA Molecule: Synthetic oligonucleotide
guagccacaauugcacaauauautt

SEQ ID NO: 2966 - DNA, 25 bp, Artificial Sequence
  Description of Artificial Sequence: Synthetic oligonucleotide
  Description of Combined DNA/RNA Molecule: Synthetic oligonucleotide
aauauauuuucuuaaaaaauaccag

SEQ ID NO: 2967 - DNA, 25 bp, Artificial Sequence
  Description of Artificial Sequence: Synthetic oligonucleotide
  Description of Combined DNA/RNA Molecule: Synthetic oligonucleotide
cuuaaaaaauaccagcaguuacuca

SEQ ID NO: 2968 - DNA, 25 bp, Artificial Sequence
  Description of Artificial Sequence: Synthetic oligonucleotide
  Description of Combined DNA/RNA Molecule: Synthetic oligonucleotide
caguuacucauggaauauauucugc

SEQ ID NO: 2969 - DNA, 25 bp, Artificial Sequence
  Description of Artificial Sequence: Synthetic oligonucleotide
  Description of Combined DNA/RNA Molecule: Synthetic oligonucleotide
cauggaauauauucugcguuuauaa

SEQ ID NO: 2970 - DNA, 25 bp, Artificial Sequence
  Description of Artificial Sequence: Synthetic oligonucleotide
  Description of Combined DNA/RNA Molecule: Synthetic oligonucleotide
auggaauauauucugcguuuauaaa

SEQ ID NO: 2971 - DNA, 25 bp, Artificial Sequence
  Description of Artificial Sequence: Synthetic oligonucleotide
  Description of Combined DNA/RNA Molecule: Synthetic oligonucleotide
uggaauauauucugcguuuauaaaa

SEQ ID NO: 2972 - DNA, 25 bp, Artificial Sequence
  Description of Artificial Sequence: Synthetic oligonucleotide
  Description of Combined DNA/RNA Molecule: Synthetic oligonucleotide
ggaauauauucugcguuuauaaaac

SEQ ID NO: 2973 - DNA, 25 bp, Artificial Sequence
  Description of Artificial Sequence: Synthetic oligonucleotide
  Description of Combined DNA/RNA Molecule: Synthetic oligonucleotide
gaauauauucugcguuuauaaaact

SEQ ID NO: 2974 - DNA, 25 bp, Artificial Sequence
  Description of Artificial Sequence: Synthetic oligonucleotide
  Description of Combined DNA/RNA Molecule: Synthetic oligonucleotide
aauauauucugcguuuauaaaacta

SEQ ID NO: 2975 - DNA, 25 bp, Artificial Sequence
  Description of Artificial Sequence: Synthetic oligonucleotide
  Description of Combined DNA/RNA Molecule: Synthetic oligonucleotide
auauauucugcguuuauaaaacuag

SEQ ID NO: 2976 - DNA, 25 bp, Artificial Sequence
  Description of Artificial Sequence: Synthetic oligonucleotide
  Description of Combined DNA/RNA Molecule: Synthetic oligonucleotide
auaaaacuaguuuuuaagaagaaat

SEQ ID NO: 2977 - DNA, 25 bp, Artificial Sequence
  Description of Artificial Sequence: Synthetic oligonucleotide
  Description of Combined DNA/RNA Molecule: Synthetic oligonucleotide
cuaguuuuuaagaagaaauuuuutt

SEQ ID NO: 2978 - DNA, 25 bp, Artificial Sequence
  Description of Artificial Sequence: Synthetic oligonucleotide
  Description of Combined DNA/RNA Molecule: Synthetic oligonucleotide
uaguuuuuaagaagaaauuuuuutt

SEQ ID NO: 2979 - DNA, 25 bp, Artificial Sequence
  Description of Artificial Sequence: Synthetic oligonucleotide
  Description of Combined DNA/RNA Molecule: Synthetic oligonucleotide
aguuuuuaagaagaaauuuuuuutg

SEQ ID NO: 2980 - DNA, 25 bp, Artificial Sequence
  Description of Artificial Sequence: Synthetic oligonucleotide
  Description of Combined DNA/RNA Molecule: Synthetic oligonucleotide
guuuuuaagaagaaauuuuuuuugg

SEQ ID NO: 2981 - DNA, 25 bp, Artificial Sequence
  Description of Artificial Sequence: Synthetic oligonucleotide
  Description of Combined DNA/RNA Molecule: Synthetic oligonucleotide
uuuaagaagaaauuuuuuuuggcct

SEQ ID NO: 2982 - DNA, 25 bp, Artificial Sequence
  Description of Artificial Sequence: Synthetic oligonucleotide
  Description of Combined DNA/RNA Molecule: Synthetic oligonucleotide
aagaaauuuuuuuuggccuaugaaa

SEQ ID NO: 2983 - DNA, 25 bp, Artificial Sequence
  Description of Artificial Sequence: Synthetic oligonucleotide
  Description of Combined DNA/RNA Molecule: Synthetic oligonucleotide
gaaauuuuuuuuggccuaugaaatt

SEQ ID NO: 2984 - DNA, 25 bp, Artificial Sequence
  Description of Artificial Sequence: Synthetic oligonucleotide
  Description of Combined DNA/RNA Molecule: Synthetic oligonucleotide
aauuuuuuuuggccuaugaaauugt

SEQ ID NO: 2985 - DNA, 25 bp, Artificial Sequence
  Description of Artificial Sequence: Synthetic oligonucleotide
  Description of Combined DNA/RNA Molecule: Synthetic oligonucleotide
uuuuuuuuggccuaugaaauuguta

SEQ ID NO: 2986 - DNA, 25 bp, Artificial Sequence
  Description of Artificial Sequence: Synthetic oligonucleotide
  Description of Combined DNA/RNA Molecule: Synthetic oligonucleotide
uuuuuggccuaugaaauuguuaaac

SEQ ID NO: 2987 - DNA, 25 bp, Artificial Sequence
  Description of Artificial Sequence: Synthetic oligonucleotide
  Description of Combined DNA/RNA Molecule: Synthetic oligonucleotide
uuuuggccuaugaaauuguuaaacc

SEQ ID NO: 2988 - DNA, 25 bp, Artificial Sequence
  Description of Artificial Sequence: Synthetic oligonucleotide
  Description of Combined DNA/RNA Molecule: Synthetic oligonucleotide
uuuggccuaugaaauuguuaaacct

SEQ ID NO: 2989 - DNA, 25 bp, Artificial Sequence
  Description of Artificial Sequence: Synthetic oligonucleotide
  Description of Combined DNA/RNA Molecule: Synthetic oligonucleotide
uuggccuaugaaauuguuaaacctg

SEQ ID NO: 2990 - DNA, 25 bp, Artificial Sequence
  Description of Artificial Sequence: Synthetic oligonucleotide
  Description of Combined DNA/RNA Molecule: Synthetic oligonucleotide
cuaugaaauuguuaaaccuggaaca

SEQ ID NO: 2991 - DNA, 25 bp, Artificial Sequence
  Description of Artificial Sequence: Synthetic oligonucleotide
  Description of Combined DNA/RNA Molecule: Synthetic oligonucleotide
augaaauuguuaaaccuggaacatg

SEQ ID NO: 2992 - DNA, 25 bp, Artificial Sequence
  Description of Artificial Sequence: Synthetic oligonucleotide
  Description of Combined DNA/RNA Molecule: Synthetic oligonucleotide
aauuguuaaaccuggaacaugacat

SEQ ID NO: 2993 - DNA, 25 bp, Artificial Sequence
  Description of Artificial Sequence: Synthetic oligonucleotide
  Description of Combined DNA/RNA Molecule: Synthetic oligonucleotide
auuguuaaaccuggaacaugacatt

SEQ ID NO: 2994 - DNA, 25 bp, Artificial Sequence
  Description of Artificial Sequence: Synthetic oligonucleotide
  Description of Combined DNA/RNA Molecule: Synthetic oligonucleotide
cuggaacaugacauuguuaaucata

SEQ ID NO: 2995 - DNA, 25 bp, Artificial Sequence
  Description of Artificial Sequence: Synthetic oligonucleotide
  Description of Combined DNA/RNA Molecule: Synthetic oligonucleotide
caugacauuguuaaucauauaauaa

SEQ ID NO: 2996 - DNA, 25 bp, Artificial Sequence
  Description of Artificial Sequence: Synthetic oligonucleotide
  Description of Combined DNA/RNA Molecule: Synthetic oligonucleotide
augacauuguuaaucauauaauaat

SEQ ID NO: 2997 - DNA, 25 bp, Artificial Sequence
  Description of Artificial Sequence: Synthetic oligonucleotide
  Description of Combined DNA/RNA Molecule: Synthetic oligonucleotide
cauuguuaaucauauaauaaugatt

SEQ ID NO: 2998 - DNA, 25 bp, Artificial Sequence
  Description of Artificial Sequence: Synthetic oligonucleotide
  Description of Combined DNA/RNA Molecule: Synthetic oligonucleotide
uuguuaaucauauaauaaugauuct

SEQ ID NO: 2999 - DNA, 25 bp, Artificial Sequence
  Description of Artificial Sequence: Synthetic oligonucleotide
  Description of Combined DNA/RNA Molecule: Synthetic oligonucleotide
uguuaaucauauaauaaugauuctt

SEQ ID NO: 3000 - DNA, 25 bp, Artificial Sequence
  Description of Artificial Sequence: Synthetic oligonucleotide
  Description of Combined DNA/RNA Molecule: Synthetic oligonucleotide
guuaaucauauaauaaugauucuta

SEQ ID NO: 3001 - DNA, 25 bp, Artificial Sequence
  Description of Artificial Sequence: Synthetic oligonucleotide
  Description of Combined DNA/RNA Molecule: Synthetic oligonucleotide
auauaauaaugauucuuaaaugctg

SEQ ID NO: 3002 - DNA, 25 bp, Artificial Sequence
  Description of Artificial Sequence: Synthetic oligonucleotide
  Description of Combined DNA/RNA Molecule: Synthetic oligonucleotide
uauaauaaugauucuuaaaugcugt

SEQ ID NO: 3003 - DNA, 25 bp, Artificial Sequence
  Description of Artificial Sequence: Synthetic oligonucleotide
  Description of Combined DNA/RNA Molecule: Synthetic oligonucleotide
auaaugauucuuaaaugcuguaugg

SEQ ID NO: 3004 - DNA, 25 bp, Artificial Sequence
  Description of Artificial Sequence: Synthetic oligonucleotide
  Description of Combined DNA/RNA Molecule: Synthetic oligonucleotide
augauucuuaaaugcuguauggutt

SEQ ID NO: 3005 - DNA, 25 bp, Artificial Sequence
  Description of Artificial Sequence: Synthetic oligonucleotide
  Description of Combined DNA/RNA Molecule: Synthetic oligonucleotide
ugauucuuaaaugcuguaugguuta

SEQ ID NO: 3006 - DNA, 25 bp, Artificial Sequence
  Description of Artificial Sequence: Synthetic oligonucleotide
  Description of Combined DNA/RNA Molecule: Synthetic oligonucleotide
gauucuuaaaugcuguaugguuuat

SEQ ID NO: 3007 - DNA, 25 bp, Artificial Sequence
  Description of Artificial Sequence: Synthetic oligonucleotide
  Description of Combined DNA/RNA Molecule: Synthetic oligonucleotide
uuaaaugcuguaugguuuauuautt

SEQ ID NO: 3008 - DNA, 25 bp, Artificial Sequence
  Description of Artificial Sequence: Synthetic oligonucleotide
  Description of Combined DNA/RNA Molecule: Synthetic oligonucleotide
uaaaugcuguaugguuuauuauuta

SEQ ID NO: 3009 - DNA, 25 bp, Artificial Sequence
  Description of Artificial Sequence: Synthetic oligonucleotide
  Description of Combined DNA/RNA Molecule: Synthetic oligonucleotide
aaugcuguaugguuuauuauuuaaa

SEQ ID NO: 3010 - DNA, 25 bp, Artificial Sequence
  Description of Artificial Sequence: Synthetic oligonucleotide
  Description of Combined DNA/RNA Molecule: Synthetic oligonucleotide
uaugguuuauuauuuaaauggguaa

SEQ ID NO: 3011 - DNA, 25 bp, Artificial Sequence
  Description of Artificial Sequence: Synthetic oligonucleotide
  Description of Combined DNA/RNA Molecule: Synthetic oligonucleotide
ugguuuauuauuuaaauggguaaag

SEQ ID NO: 3012 - DNA, 25 bp, Artificial Sequence
  Description of Artificial Sequence: Synthetic oligonucleotide
  Description of Combined DNA/RNA Molecule: Synthetic oligonucleotide
gguuuauuauuuaaauggguaaagc

SEQ ID NO: 3013 - DNA, 25 bp, Artificial Sequence
  Description of Artificial Sequence: Synthetic oligonucleotide
  Description of Combined DNA/RNA Molecule: Synthetic oligonucleotide
uuuauuauuuaaauggguaaagcca

SEQ ID NO: 3014 - DNA, 25 bp, Artificial Sequence
  Description of Artificial Sequence: Synthetic oligonucleotide
  Description of Combined DNA/RNA Molecule: Synthetic oligonucleotide
uuauuauuuaaauggguaaagccat

SEQ ID NO: 3015 - DNA, 25 bp, Artificial Sequence
  Description of Artificial Sequence: Synthetic oligonucleotide
  Description of Combined DNA/RNA Molecule: Synthetic oligonucleotide
auuuaaauggguaaagccauuuaca

SEQ ID NO: 3016 - DNA, 25 bp, Artificial Sequence
  Description of Artificial Sequence: Synthetic oligonucleotide
  Description of Combined DNA/RNA Molecule: Synthetic oligonucleotide
auggguaaagccauuuacauaauat

SEQ ID NO: 3017 - DNA, 25 bp, Artificial Sequence
  Description of Artificial Sequence: Synthetic oligonucleotide
  Description of Combined DNA/RNA Molecule: Synthetic oligonucleotide
gguaaagccauuuacauaauauaga

SEQ ID NO: 3018 - DNA, 25 bp, Artificial Sequence
  Description of Artificial Sequence: Synthetic oligonucleotide
  Description of Combined DNA/RNA Molecule: Synthetic oligonucleotide
uaaagccauuuacauaauauagaaa

SEQ ID NO: 3019 - DNA, 25 bp, Artificial Sequence
  Description of Artificial Sequence: Synthetic oligonucleotide
  Description of Combined DNA/RNA Molecule: Synthetic oligonucleotide
aaagccauuuacauaauauagaaag

SEQ ID NO: 3020 - DNA, 25 bp, Artificial Sequence
  Description of Artificial Sequence: Synthetic oligonucleotide
  Description of Combined DNA/RNA Molecule: Synthetic oligonucleotide
cauuuacauaauauagaaagauatg

SEQ ID NO: 3021 - DNA, 25 bp, Artificial Sequence
  Description of Artificial Sequence: Synthetic oligonucleotide
  Description of Combined DNA/RNA Molecule: Synthetic oligonucleotide
aauauagaaagauaugcauauauct

SEQ ID NO: 3022 - DNA, 25 bp, Artificial Sequence
  Description of Artificial Sequence: Synthetic oligonucleotide
  Description of Combined DNA/RNA Molecule: Synthetic oligonucleotide
auauagaaagauaugcauauaucta

SEQ ID NO: 3023 - DNA, 25 bp, Artificial Sequence
  Description of Artificial Sequence: Synthetic oligonucleotide
  Description of Combined DNA/RNA Molecule: Synthetic oligonucleotide
uauagaaagauaugcauauaucuag

SEQ ID NO: 3024 - DNA, 25 bp, Artificial Sequence
  Description of Artificial Sequence: Synthetic oligonucleotide
  Description of Combined DNA/RNA Molecule: Synthetic oligonucleotide
gaaagauaugcauauaucuagaagg

SEQ ID NO: 3025 - DNA, 25 bp, Artificial Sequence
  Description of Artificial Sequence: Synthetic oligonucleotide
  Description of Combined DNA/RNA Molecule: Synthetic oligonucleotide
agauaugcauauaucuagaagguat

SEQ ID NO: 3026 - DNA, 25 bp, Artificial Sequence
  Description of Artificial Sequence: Synthetic oligonucleotide
  Description of Combined DNA/RNA Molecule: Synthetic oligonucleotide
gauaugcauauaucuagaagguatg

SEQ ID NO: 3027 - DNA, 25 bp, Artificial Sequence
  Description of Artificial Sequence: Synthetic oligonucleotide
  Description of Combined DNA/RNA Molecule: Synthetic oligonucleotide
auaugcauauaucuagaagguaugt

SEQ ID NO: 3028 - DNA, 25 bp, Artificial Sequence
  Description of Artificial Sequence: Synthetic oligonucleotide
  Description of Combined DNA/RNA Molecule: Synthetic oligonucleotide
cauauaucuagaagguauguggcat

SEQ ID NO: 3029 - DNA, 25 bp, Artificial Sequence
  Description of Artificial Sequence: Synthetic oligonucleotide
  Description of Combined DNA/RNA Molecule: Synthetic oligonucleotide
auauaucuagaagguauguggcatt

SEQ ID NO: 3030 - DNA, 25 bp, Artificial Sequence
  Description of Artificial Sequence: Synthetic oligonucleotide
  Description of Combined DNA/RNA Molecule: Synthetic oligonucleotide
uagaagguauguggcauuuauuugg

SEQ ID NO: 3031 - DNA, 25 bp, Artificial Sequence
  Description of Artificial Sequence: Synthetic oligonucleotide
  Description of Combined DNA/RNA Molecule: Synthetic oligonucleotide
agguauguggcauuuauuuggauaa

SEQ ID NO: 3032 - DNA, 25 bp, Artificial Sequence
  Description of Artificial Sequence: Synthetic oligonucleotide
  Description of Combined DNA/RNA Molecule: Synthetic oligonucleotide
auguggcauuuauuuggauaaaatt

SEQ ID NO: 3033 - DNA, 25 bp, Artificial Sequence
  Description of Artificial Sequence: Synthetic oligonucleotide
  Description of Combined DNA/RNA Molecule: Synthetic oligonucleotide
guggcauuuauuuggauaaaauuct

SEQ ID NO: 3034 - DNA, 25 bp, Artificial Sequence
  Description of Artificial Sequence: Synthetic oligonucleotide
  Description of Combined DNA/RNA Molecule: Synthetic oligonucleotide
uauuuggauaaaauucucaauucag

SEQ ID NO: 3035 - DNA, 25 bp, Artificial Sequence
  Description of Artificial Sequence: Synthetic oligonucleotide
  Description of Combined DNA/RNA Molecule: Synthetic oligonucleotide
gauaaaauucucaauucagagaaat

SEQ ID NO: 3036 - DNA, 25 bp, Artificial Sequence
  Description of Artificial Sequence: Synthetic oligonucleotide
  Description of Combined DNA/RNA Molecule: Synthetic oligonucleotide
uaaaauucucaauucagagaaauca

SEQ ID NO: 3037 - DNA, 25 bp, Artificial Sequence
  Description of Artificial Sequence: Synthetic oligonucleotide
  Description of Combined DNA/RNA Molecule: Synthetic oligonucleotide
aaauucucaauucagagaaaucatc

SEQ ID NO: 3038 - DNA, 25 bp, Artificial Sequence
  Description of Artificial Sequence: Synthetic oligonucleotide
  Description of Combined DNA/RNA Molecule: Synthetic oligonucleotide
aauucagagaaaucaucugaugutt

SEQ ID NO: 3039 - DNA, 25 bp, Artificial Sequence
  Description of Artificial Sequence: Synthetic oligonucleotide
  Description of Combined DNA/RNA Molecule: Synthetic oligonucleotide
cagagaaaucaucugauguuucuat

SEQ ID NO: 3040 - DNA, 25 bp, Artificial Sequence
  Description of Artificial Sequence: Synthetic oligonucleotide
  Description of Combined DNA/RNA Molecule: Synthetic oligonucleotide
aaaucaucugauguuucuauaguca

SEQ ID NO: 3041 - DNA, 25 bp, Artificial Sequence
  Description of Artificial Sequence: Synthetic oligonucleotide
  Description of Combined DNA/RNA Molecule: Synthetic oligonucleotide
ugauguuucuauagucacuuugcca

SEQ ID NO: 3042 - DNA, 25 bp, Artificial Sequence
  Description of Artificial Sequence: Synthetic oligonucleotide
  Description of Combined DNA/RNA Molecule: Synthetic oligonucleotide
gauguuucuauagucacuuugccag

SEQ ID NO: 3043 - DNA, 25 bp, Artificial Sequence
  Description of Artificial Sequence: Synthetic oligonucleotide
  Description of Combined DNA/RNA Molecule: Synthetic oligonucleotide
aaaagaaaacaauacccuauguagt

SEQ ID NO: 3044 - DNA, 25 bp, Artificial Sequence
  Description of Artificial Sequence: Synthetic oligonucleotide
  Description of Combined DNA/RNA Molecule: Synthetic oligonucleotide
aagaaaacaauacccuauguagutg

SEQ ID NO: 3045 - DNA, 25 bp, Artificial Sequence
  Description of Artificial Sequence: Synthetic oligonucleotide
  Description of Combined DNA/RNA Molecule: Synthetic oligonucleotide
agaaaacaauacccuauguaguugt

SEQ ID NO: 3046 - DNA, 25 bp, Artificial Sequence
  Description of Artificial Sequence: Synthetic oligonucleotide
  Description of Combined DNA/RNA Molecule: Synthetic oligonucleotide
aaaacaauacccuauguaguugugg

SEQ ID NO: 3047 - DNA, 25 bp, Artificial Sequence
  Description of Artificial Sequence: Synthetic oligonucleotide
  Description of Combined DNA/RNA Molecule: Synthetic oligonucleotide
caauacccuauguaguuguggaagt

SEQ ID NO: 3048 - DNA, 25 bp, Artificial Sequence
  Description of Artificial Sequence: Synthetic oligonucleotide
  Description of Combined DNA/RNA Molecule: Synthetic oligonucleotide
uauguaguuguggaaguuuaugcta

SEQ ID NO: 3049 - DNA, 25 bp, Artificial Sequence
  Description of Artificial Sequence: Synthetic oligonucleotide
  Description of Combined DNA/RNA Molecule: Synthetic oligonucleotide
auguaguuguggaaguuuaugcuaa

SEQ ID NO: 3050 - DNA, 25 bp, Artificial Sequence
  Description of Artificial Sequence: Synthetic oligonucleotide
  Description of Combined DNA/RNA Molecule: Synthetic oligonucleotide
guuguggaaguuuaugcuaauautg

SEQ ID NO: 3051 - DNA, 25 bp, Artificial Sequence
  Description of Artificial Sequence: Synthetic oligonucleotide
  Description of Combined DNA/RNA Molecule: Synthetic oligonucleotide
uuguggaaguuuaugcuaauauugt

SEQ ID NO: 3052 - DNA, 25 bp, Artificial Sequence
  Description of Artificial Sequence: Synthetic oligonucleotide
  Description of Combined DNA/RNA Molecule: Synthetic oligonucleotide
guggaaguuuaugcuaauauugugt

SEQ ID NO: 3053 - DNA, 25 bp, Artificial Sequence
  Description of Artificial Sequence: Synthetic oligonucleotide
  Description of Combined DNA/RNA Molecule: Synthetic oligonucleotide
ggaaguuuaugcuaauauuguguaa

SEQ ID NO: 3054 - DNA, 25 bp, Artificial Sequence
  Description of Artificial Sequence: Synthetic oligonucleotide
  Description of Combined DNA/RNA Molecule: Synthetic oligonucleotide
gaaguuuaugcuaauauuguguaac

SEQ ID NO: 3055 - DNA, 25 bp, Artificial Sequence
  Description of Artificial Sequence: Synthetic oligonucleotide
  Description of Combined DNA/RNA Molecule: Synthetic oligonucleotide
aaguuuaugcuaauauuguguaact

SEQ ID NO: 3056 - DNA, 25 bp, Artificial Sequence
  Description of Artificial Sequence: Synthetic oligonucleotide
  Description of Combined DNA/RNA Molecule: Synthetic oligonucleotide
guuuaugcuaauauuguguaacuga

SEQ ID NO: 3057 - DNA, 25 bp, Artificial Sequence
  Description of Artificial Sequence: Synthetic oligonucleotide
  Description of Combined DNA/RNA Molecule: Synthetic oligonucleotide
cuaauauuguguaacugauauuaaa

SEQ ID NO: 3058 - DNA, 25 bp, Artificial Sequence
  Description of Artificial Sequence: Synthetic oligonucleotide
  Description of Combined DNA/RNA Molecule: Synthetic oligonucleotide
aauauuguguaacugauauuaaacc

SEQ ID NO: 3059 - DNA, 25 bp, Artificial Sequence
  Description of Artificial Sequence: Synthetic oligonucleotide
  Description of Combined DNA/RNA Molecule: Synthetic oligonucleotide
uauuguguaacugauauuaaaccta

SEQ ID NO: 3060 - DNA, 25 bp, Artificial Sequence
  Description of Artificial Sequence: Synthetic oligonucleotide
  Description of Combined DNA/RNA Molecule: Synthetic oligonucleotide
cugauauuaaaccuaaauguucugc

SEQ ID NO: 3061 - DNA, 25 bp, Artificial Sequence
  Description of Artificial Sequence: Synthetic oligonucleotide
  Description of Combined DNA/RNA Molecule: Synthetic oligonucleotide
guugguauaaagauauuuugagcag

SEQ ID NO: 3062 - DNA, 25 bp, Artificial Sequence
  Description of Artificial Sequence: Synthetic oligonucleotide
  Description of Combined DNA/RNA Molecule: Synthetic oligonucleotide
uauaaagauauuuugagcagacugt

SEQ ID NO: 3063 - DNA, 25 bp, Artificial Sequence
  Description of Artificial Sequence: Synthetic oligonucleotide
  Description of Combined DNA/RNA Molecule: Synthetic oligonucleotide
aagauauuuugagcagacuguaaac

SEQ ID NO: 3064 - DNA, 25 bp, Artificial Sequence
  Description of Artificial Sequence: Synthetic oligonucleotide
  Description of Combined DNA/RNA Molecule: Synthetic oligonucleotide
agauauuuugagcagacuguaaaca

SEQ ID NO: 3065 - DNA, 25 bp, Artificial Sequence
  Description of Artificial Sequence: Synthetic oligonucleotide
  Description of Combined DNA/RNA Molecule: Synthetic oligonucleotide
gauauuuugagcagacuguaaacaa

SEQ ID NO: 3066 - DNA, 25 bp, Artificial Sequence
  Description of Artificial Sequence: Synthetic oligonucleotide
  Description of Combined DNA/RNA Molecule: Synthetic oligonucleotide
uuugagcagacuguaaacaagaaaa

SEQ ID NO: 3067 - DNA, 25 bp, Artificial Sequence
  Description of Artificial Sequence: Synthetic oligonucleotide
  Description of Combined DNA/RNA Molecule: Synthetic oligonucleotide
ugagcagacuguaaacaagaaaaaa

SEQ ID NO: 3068 - DNA, 25 bp, Artificial Sequence
  Description of Artificial Sequence: Synthetic oligonucleotide
  Description of Combined DNA/RNA Molecule: Synthetic oligonucleotide
cagacuguaaacaagaaaaaaaaaa

SEQ ID NO: 3069 - DNA, 25 bp, Artificial Sequence
  Description of Artificial Sequence: Synthetic oligonucleotide
  Description of Combined DNA/RNA Molecule: Synthetic oligonucleotide
cuguaaacaagaaaaaaaaaaucat

SEQ ID NO: 3070 - DNA, 25 bp, Artificial Sequence
  Description of Artificial Sequence: Synthetic oligonucleotide
  Description of Combined DNA/RNA Molecule: Synthetic oligonucleotide
uguaaacaagaaaaaaaaaaucatg

SEQ ID NO: 3071 - DNA, 25 bp, Artificial Sequence
  Description of Artificial Sequence: Synthetic oligonucleotide
  Description of Combined DNA/RNA Molecule: Synthetic oligonucleotide
aaaaaaaaucaugcauucuuagcaa

SEQ ID NO: 3072 - DNA, 25 bp, Artificial Sequence
  Description of Artificial Sequence: Synthetic oligonucleotide
  Description of Combined DNA/RNA Molecule: Synthetic oligonucleotide
aaaaaaaucaugcauucuuagcaaa

SEQ ID NO: 3073 - DNA, 25 bp, Artificial Sequence
  Description of Artificial Sequence: Synthetic oligonucleotide
  Description of Combined DNA/RNA Molecule: Synthetic oligonucleotide
caugcauucuuagcaaaauugccta

SEQ ID NO: 3074 - DNA, 25 bp, Artificial Sequence
  Description of Artificial Sequence: Synthetic oligonucleotide
  Description of Combined DNA/RNA Molecule: Synthetic oligonucleotide
cuuagcaaaauugccuaguauguta

SEQ ID NO: 3075 - DNA, 25 bp, Artificial Sequence
  Description of Artificial Sequence: Synthetic oligonucleotide
  Description of Combined DNA/RNA Molecule: Synthetic oligonucleotide
uuagcaaaauugccuaguauguuaa

SEQ ID NO: 3076 - DNA, 25 bp, Artificial Sequence
  Description of Artificial Sequence: Synthetic oligonucleotide
  Description of Combined DNA/RNA Molecule: Synthetic oligonucleotide
aaaauugccuaguauguuaauuugc

SEQ ID NO: 3077 - DNA, 25 bp, Artificial Sequence
  Description of Artificial Sequence: Synthetic oligonucleotide
  Description of Combined DNA/RNA Molecule: Synthetic oligonucleotide
aauugccuaguauguuaauuugctc

SEQ ID NO: 3078 - DNA, 25 bp, Artificial Sequence
  Description of Artificial Sequence: Synthetic oligonucleotide
  Description of Combined DNA/RNA Molecule: Synthetic oligonucleotide
auugccuaguauguuaauuugcuca

SEQ ID NO: 3079 - DNA, 25 bp, Artificial Sequence
  Description of Artificial Sequence: Synthetic oligonucleotide
  Description of Combined DNA/RNA Molecule: Synthetic oligonucleotide
uaguauguuaauuugcucaaaauac

SEQ ID NO: 3080 - DNA, 25 bp, Artificial Sequence
  Description of Artificial Sequence: Synthetic oligonucleotide
  Description of Combined DNA/RNA Molecule: Synthetic oligonucleotide
aguauguuaauuugcucaaaauaca

SEQ ID NO: 3081 - DNA, 25 bp, Artificial Sequence
  Description of Artificial Sequence: Synthetic oligonucleotide
  Description of Combined DNA/RNA Molecule: Synthetic oligonucleotide
guauguuaauuugcucaaaauacaa

SEQ ID NO: 3082 - DNA, 25 bp, Artificial Sequence
  Description of Artificial Sequence: Synthetic oligonucleotide
  Description of Combined DNA/RNA Molecule: Synthetic oligonucleotide
uaauuugcucaaaauacaauguutg

SEQ ID NO: 3083 - DNA, 25 bp, Artificial Sequence
  Description of Artificial Sequence: Synthetic oligonucleotide
  Description of Combined DNA/RNA Molecule: Synthetic oligonucleotide
aauuugcucaaaauacaauguuuga

SEQ ID NO: 3084 - DNA, 25 bp, Artificial Sequence
  Description of Artificial Sequence: Synthetic oligonucleotide
  Description of Combined DNA/RNA Molecule: Synthetic oligonucleotide
uuugcucaaaauacaauguuugatt

SEQ ID NO: 3085 - DNA, 25 bp, Artificial Sequence
  Description of Artificial Sequence: Synthetic oligonucleotide
  Description of Combined DNA/RNA Molecule: Synthetic oligonucleotide
caaaauacaauguuugauuuuaugc

SEQ ID NO: 3086 - DNA, 25 bp, Artificial Sequence
  Description of Artificial Sequence: Synthetic oligonucleotide
  Description of Combined DNA/RNA Molecule: Synthetic oligonucleotide
aaauacaauguuugauuuuaugcac

SEQ ID NO: 3087 - DNA, 25 bp, Artificial Sequence
  Description of Artificial Sequence: Synthetic oligonucleotide
  Description of Combined DNA/RNA Molecule: Synthetic oligonucleotide
aauacaauguuugauuuuaugcact

SEQ ID NO: 3088 - DNA, 25 bp, Artificial Sequence
  Description of Artificial Sequence: Synthetic oligonucleotide
  Description of Combined DNA/RNA Molecule: Synthetic oligonucleotide
auguuugauuuuaugcacuuugucg

SEQ ID NO: 3089 - DNA, 25 bp, Artificial Sequence
  Description of Artificial Sequence: Synthetic oligonucleotide
  Description of Combined DNA/RNA Molecule: Synthetic oligonucleotide
uguuugauuuuaugcacuuugucgc

SEQ ID NO: 3090 - DNA, 25 bp, Artificial Sequence
  Description of Artificial Sequence: Synthetic oligonucleotide
  Description of Combined DNA/RNA Molecule: Synthetic oligonucleotide
uaugcacuuugucgcuauuaacatc

SEQ ID NO: 3091 - DNA, 25 bp, Artificial Sequence
  Description of Artificial Sequence: Synthetic oligonucleotide
  Description of Combined DNA/RNA Molecule: Synthetic oligonucleotide
uugucgcuauuaacauccuuuuutt

SEQ ID NO: 3092 - DNA, 25 bp, Artificial Sequence
  Description of Artificial Sequence: Synthetic oligonucleotide
  Description of Combined DNA/RNA Molecule: Synthetic oligonucleotide
uuuuuucauguagauuucaauaatt

SEQ ID NO: 3093 - DNA, 25 bp, Artificial Sequence
  Description of Artificial Sequence: Synthetic oligonucleotide
  Description of Combined DNA/RNA Molecule: Synthetic oligonucleotide
uuuuucauguagauuucaauaautg

SEQ ID NO: 3094 - DNA, 25 bp, Artificial Sequence
  Description of Artificial Sequence: Synthetic oligonucleotide
  Description of Combined DNA/RNA Molecule: Synthetic oligonucleotide
cauguagauuucaauaauugaguaa

SEQ ID NO: 3095 - DNA, 25 bp, Artificial Sequence
  Description of Artificial Sequence: Synthetic oligonucleotide
  Description of Combined DNA/RNA Molecule: Synthetic oligonucleotide
auguagauuucaauaauugaguaat

SEQ ID NO: 3096 - DNA, 25 bp, Artificial Sequence
  Description of Artificial Sequence: Synthetic oligonucleotide
  Description of Combined DNA/RNA Molecule: Synthetic oligonucleotide
uguagauuucaauaauugaguaatt

SEQ ID NO: 3097 - DNA, 25 bp, Artificial Sequence
  Description of Artificial Sequence: Synthetic oligonucleotide
  Description of Combined DNA/RNA Molecule: Synthetic oligonucleotide
guagauuucaauaauugaguaautt

SEQ ID NO: 3098 - DNA, 25 bp, Artificial Sequence
  Description of Artificial Sequence: Synthetic oligonucleotide
  Description of Combined DNA/RNA Molecule: Synthetic oligonucleotide
uagauuucaauaauugaguaauutt

SEQ ID NO: 3099 - DNA, 25 bp, Artificial Sequence
  Description of Artificial Sequence: Synthetic oligonucleotide
  Description of Combined DNA/RNA Molecule: Synthetic oligonucleotide
agauuucaauaauugaguaauuuta

SEQ ID NO: 3100 - DNA, 25 bp, Artificial Sequence
  Description of Artificial Sequence: Synthetic oligonucleotide
  Description of Combined DNA/RNA Molecule: Synthetic oligonucleotide
gauuucaauaauugaguaauuuuag

SEQ ID NO: 3101 - DNA, 25 bp, Artificial Sequence
  Description of Artificial Sequence: Synthetic oligonucleotide
  Description of Combined DNA/RNA Molecule: Synthetic oligonucleotide
auuucaauaauugaguaauuuuaga

SEQ ID NO: 3102 - DNA, 25 bp, Artificial Sequence
  Description of Artificial Sequence: Synthetic oligonucleotide
  Description of Combined DNA/RNA Molecule: Synthetic oligonucleotide
auaauugaguaauuuuagaagcatt

SEQ ID NO: 3103 - DNA, 25 bp, Artificial Sequence
  Description of Artificial Sequence: Synthetic oligonucleotide
  Description of Combined DNA/RNA Molecule: Synthetic oligonucleotide
uugaguaauuuuagaagcauuautt

SEQ ID NO: 3104 - DNA, 25 bp, Artificial Sequence
  Description of Artificial Sequence: Synthetic oligonucleotide
  Description of Combined DNA/RNA Molecule: Synthetic oligonucleotide
ugaguaauuuuagaagcauuauutt

SEQ ID NO: 3105 - DNA, 25 bp, Artificial Sequence
  Description of Artificial Sequence: Synthetic oligonucleotide
  Description of Combined DNA/RNA Molecule: Synthetic oligonucleotide
aguaauuuuagaagcauuauuuuag

SEQ ID NO: 3106 - DNA, 25 bp, Artificial Sequence
  Description of Artificial Sequence: Synthetic oligonucleotide
  Description of Combined DNA/RNA Molecule: Synthetic oligonucleotide
auuuuagaagcauuauuuuaggaat

SEQ ID NO: 3107 - DNA, 25 bp, Artificial Sequence
  Description of Artificial Sequence: Synthetic oligonucleotide
  Description of Combined DNA/RNA Molecule: Synthetic oligonucleotide
uagaagcauuauuuuaggaauauat

SEQ ID NO: 3108 - DNA, 25 bp, Artificial Sequence
  Description of Artificial Sequence: Synthetic oligonucleotide
  Description of Combined DNA/RNA Molecule: Synthetic oligonucleotide
gaagcauuauuuuaggaauauauag

SEQ ID NO: 3109 - DNA, 25 bp, Artificial Sequence
  Description of Artificial Sequence: Synthetic oligonucleotide
  Description of Combined DNA/RNA Molecule: Synthetic oligonucleotide
cauuauuuuaggaauauauaguugt

SEQ ID NO: 3110 - DNA, 25 bp, Artificial Sequence
  Description of Artificial Sequence: Synthetic oligonucleotide
  Description of Combined DNA/RNA Molecule: Synthetic oligonucleotide
uuauuuuaggaauauauaguuguca

SEQ ID NO: 3111 - DNA, 25 bp, Artificial Sequence
  Description of Artificial Sequence: Synthetic oligonucleotide
  Description of Combined DNA/RNA Molecule: Synthetic oligonucleotide
ggaauauauaguugucacaguaaat

SEQ ID NO: 3112 - DNA, 25 bp, Artificial Sequence
  Description of Artificial Sequence: Synthetic oligonucleotide
  Description of Combined DNA/RNA Molecule: Synthetic oligonucleotide
gaauauauaguugucacaguaaata

SEQ ID NO: 3113 - DNA, 25 bp, Artificial Sequence
  Description of Artificial Sequence: Synthetic oligonucleotide
  Description of Combined DNA/RNA Molecule: Synthetic oligonucleotide
aauauauaguugucacaguaaauat

SEQ ID NO: 3114 - DNA, 25 bp, Artificial Sequence
  Description of Artificial Sequence: Synthetic oligonucleotide
  Description of Combined DNA/RNA Molecule: Synthetic oligonucleotide
uauauaguugucacaguaaauauct

SEQ ID NO: 3115 - DNA, 25 bp, Artificial Sequence
  Description of Artificial Sequence: Synthetic oligonucleotide
  Description of Combined DNA/RNA Molecule: Synthetic oligonucleotide
auauaguugucacaguaaauauctt

SEQ ID NO: 3116 - DNA, 25 bp, Artificial Sequence
  Description of Artificial Sequence: Synthetic oligonucleotide
  Description of Combined DNA/RNA Molecule: Synthetic oligonucleotide
guugucacaguaaauaucuuguutt

SEQ ID NO: 3117 - DNA, 25 bp, Artificial Sequence
  Description of Artificial Sequence: Synthetic oligonucleotide
  Description of Combined DNA/RNA Molecule: Synthetic oligonucleotide
uugucacaguaaauaucuuguuutt

SEQ ID NO: 3118 - DNA, 25 bp, Artificial Sequence
  Description of Artificial Sequence: Synthetic oligonucleotide
  Description of Combined DNA/RNA Molecule: Synthetic oligonucleotide
aaauaucuuguuuuuucuauguaca

SEQ ID NO: 3119 - DNA, 25 bp, Artificial Sequence
  Description of Artificial Sequence: Synthetic oligonucleotide
  Description of Combined DNA/RNA Molecule: Synthetic oligonucleotide
aauaucuuguuuuuucuauguacat

SEQ ID NO: 3120 - DNA, 25 bp, Artificial Sequence
  Description of Artificial Sequence: Synthetic oligonucleotide
  Description of Combined DNA/RNA Molecule: Synthetic oligonucleotide
cuuguuuuuucuauguacauuguac

SEQ ID NO: 3121 - DNA, 25 bp, Artificial Sequence
  Description of Artificial Sequence: Synthetic oligonucleotide
  Description of Combined DNA/RNA Molecule: Synthetic oligonucleotide
uuguuuuuucuauguacauuguaca

SEQ ID NO: 3122 - DNA, 25 bp, Artificial Sequence
  Description of Artificial Sequence: Synthetic oligonucleotide
  Description of Combined DNA/RNA Molecule: Synthetic oligonucleotide
uguuuuuucuauguacauuguacaa

SEQ ID NO: 3123 - DNA, 25 bp, Artificial Sequence
  Description of Artificial Sequence: Synthetic oligonucleotide
  Description of Combined DNA/RNA Molecule: Synthetic oligonucleotide
guuuuuucuauguacauuguacaaa

SEQ ID NO: 3124 - DNA, 25 bp, Artificial Sequence
  Description of Artificial Sequence: Synthetic oligonucleotide
  Description of Combined DNA/RNA Molecule: Synthetic oligonucleotide
cuauguacauuguacaaauuuuuca

SEQ ID NO: 3125 - DNA, 25 bp, Artificial Sequence
  Description of Artificial Sequence: Synthetic oligonucleotide
  Description of Combined DNA/RNA Molecule: Synthetic oligonucleotide
uauguacauuguacaaauuuuucat

SEQ ID NO: 3126 - DNA, 25 bp, Artificial Sequence
  Description of Artificial Sequence: Synthetic oligonucleotide
  Description of Combined DNA/RNA Molecule: Synthetic oligonucleotide
uuuucauuccuuuugcucuuugugg

SEQ ID NO: 3127 - DNA, 25 bp, Artificial Sequence
  Description of Artificial Sequence: Synthetic oligonucleotide
  Description of Combined DNA/RNA Molecule: Synthetic oligonucleotide
guuggaucuaacacuaacuguautg

SEQ ID NO: 3128 - DNA, 25 bp, Artificial Sequence
  Description of Artificial Sequence: Synthetic oligonucleotide
  Description of Combined DNA/RNA Molecule: Synthetic oligonucleotide
uuggaucuaacacuaacuguauugt

SEQ ID NO: 3129 - DNA, 25 bp, Artificial Sequence
  Description of Artificial Sequence: Synthetic oligonucleotide
  Description of Combined DNA/RNA Molecule: Synthetic oligonucleotide
ggaucuaacacuaacuguauugutt

SEQ ID NO: 3130 - DNA, 25 bp, Artificial Sequence
  Description of Artificial Sequence: Synthetic oligonucleotide
  Description of Combined DNA/RNA Molecule: Synthetic oligonucleotide
guauuguuuuguuacaucaaauaaa

SEQ ID NO: 3131 - DNA, 25 bp, Artificial Sequence
  Description of Artificial Sequence: Synthetic oligonucleotide
  Description of Combined DNA/RNA Molecule: Synthetic oligonucleotide
uauuguuuuguuacaucaaauaaac

SEQ ID NO: 3132 - DNA, 25 bp, Artificial Sequence
  Description of Artificial Sequence: Synthetic oligonucleotide
  Description of Combined DNA/RNA Molecule: Synthetic oligonucleotide
auuguuuuguuacaucaaauaaaca

SEQ ID NO: 3133 - DNA, 25 bp, Artificial Sequence
  Description of Artificial Sequence: Synthetic oligonucleotide
  Description of Combined DNA/RNA Molecule: Synthetic oligonucleotide
uguuuuguuacaucaaauaaacatc

SEQ ID NO: 3134 - DNA, 25 bp, Artificial Sequence
  Description of Artificial Sequence: Synthetic oligonucleotide
  Description of Combined DNA/RNA Molecule: Synthetic oligonucleotide
uguggaccaggcaaaaaaaaaaaaa

SEQ ID NO: 3135 - DNA, 25 bp, Artificial Sequence
  Description of Artificial Sequence: Synthetic oligonucleotide
  Description of Combined DNA/RNA Molecule: Synthetic oligonucleotide
guggaccaggcaaaaaaaaaaaaaa

SEQ ID NO: 3136 - DNA, 25 bp, Artificial Sequence
  Description of Artificial Sequence: Synthetic oligonucleotide
  Description of Combined DNA/RNA Molecule: Synthetic oligonucleotide
caggcaaaaaaaaaaaaaaaaaaaa

SEQ ID NO: 3137 - DNA, 25 bp, Artificial Sequence
  Description of Artificial Sequence: Synthetic oligonucleotide
  Description of Combined DNA/RNA Molecule: Synthetic oligonucleotide
cuuuuucaagcaguaggaauuautt

SEQ ID NO: 3138 - DNA, 25 bp, Artificial Sequence
  Description of Artificial Sequence: Synthetic oligonucleotide
  Description of Combined DNA/RNA Molecule: Synthetic oligonucleotide
uuuuucaagcaguaggaauuauuta

SEQ ID NO: 3139 - DNA, 25 bp, Artificial Sequence
  Description of Artificial Sequence: Synthetic oligonucleotide
  Description of Combined DNA/RNA Molecule: Synthetic oligonucleotide
caagcaguaggaauuauuuagcatg

SEQ ID NO: 3140 - DNA, 25 bp, Artificial Sequence
  Description of Artificial Sequence: Synthetic oligonucleotide
  Description of Combined DNA/RNA Molecule: Synthetic oligonucleotide
caguaggaauuauuuagcauguaga

SEQ ID NO: 3141 - DNA, 25 bp, Artificial Sequence
  Description of Artificial Sequence: Synthetic oligonucleotide
  Description of Combined DNA/RNA Molecule: Synthetic oligonucleotide
guaggaauuauuuagcauguagact

SEQ ID NO: 3142 - DNA, 25 bp, Artificial Sequence
  Description of Artificial Sequence: Synthetic oligonucleotide
  Description of Combined DNA/RNA Molecule: Synthetic oligonucleotide
uaggaauuauuuagcauguagactg

SEQ ID NO: 3143 - DNA, 25 bp, Artificial Sequence
  Description of Artificial Sequence: Synthetic oligonucleotide
  Description of Combined DNA/RNA Molecule: Synthetic oligonucleotide
aggaauuauuuagcauguagacugc

SEQ ID NO: 3144 - DNA, 27 bp, Artificial Sequence
  Description of Artificial Sequence: Synthetic oligonucleotide
  Description of Combined DNA/RNA Molecule: Synthetic oligonucleotide
aaagataagttctgaacgtcgaaaaga

SEQ ID NO: 3145 - DNA, 27 bp, Artificial Sequence
  Description of Artificial Sequence: Synthetic oligonucleotide
  Description of Combined DNA/RNA Molecule: Synthetic oligonucleotide
gataagttctgaacgtcgaaaagaaaa

SEQ ID NO: 3146 - DNA, 27 bp, Artificial Sequence
  Description of Artificial Sequence: Synthetic oligonucleotide
  Description of Combined DNA/RNA Molecule: Synthetic oligonucleotide
taagttctgaacgtcgaaaagaaaagt

SEQ ID NO: 3147 - DNA, 27 bp, Artificial Sequence
  Description of Artificial Sequence: Synthetic oligonucleotide
  Description of Combined DNA/RNA Molecule: Synthetic oligonucleotide
ttctgaacgtcgaaaagaaaagtctcg

SEQ ID NO: 3148 - DNA, 27 bp, Artificial Sequence
  Description of Artificial Sequence: Synthetic oligonucleotide
  Description of Combined DNA/RNA Molecule: Synthetic oligonucleotide
gtcgaaaagaaaagtctcgagatgcag

SEQ ID NO: 3149 - DNA, 27 bp, Artificial Sequence
  Description of Artificial Sequence: Synthetic oligonucleotide
  Description of Combined DNA/RNA Molecule: Synthetic oligonucleotide
tcgaaaagaaaagtctcgagatgcagc

SEQ ID NO: 3150 - DNA, 27 bp, Artificial Sequence
  Description of Artificial Sequence: Synthetic oligonucleotide
  Description of Combined DNA/RNA Molecule: Synthetic oligonucleotide
ggcgaagtaaagaatctgaagtttttt

SEQ ID NO: 3151 - DNA, 27 bp, Artificial Sequence
  Description of Artificial Sequence: Synthetic oligonucleotide
  Description of Combined DNA/RNA Molecule: Synthetic oligonucleotide
gcgaagtaaagaatctgaagtttttta

SEQ ID NO: 3152 - DNA, 27 bp, Artificial Sequence
  Description of Artificial Sequence: Synthetic oligonucleotide
  Description of Combined DNA/RNA Molecule: Synthetic oligonucleotide
gaagtaaagaatctgaagttttttatg

SEQ ID NO: 3153 - DNA, 27 bp, Artificial Sequence
  Description of Artificial Sequence: Synthetic oligonucleotide
  Description of Combined DNA/RNA Molecule: Synthetic oligonucleotide
aagtaaagaatctgaagttttttatga

SEQ ID NO: 3154 - DNA, 27 bp, Artificial Sequence
  Description of Artificial Sequence: Synthetic oligonucleotide
  Description of Combined DNA/RNA Molecule: Synthetic oligonucleotide
gtaaagaatctgaagttttttatgagc

SEQ ID NO: 3155 - DNA, 27 bp, Artificial Sequence
  Description of Artificial Sequence: Synthetic oligonucleotide
  Description of Combined DNA/RNA Molecule: Synthetic oligonucleotide
atctgaagttttttatgagcttgctca

SEQ ID NO: 3156 - DNA, 27 bp, Artificial Sequence
  Description of Artificial Sequence: Synthetic oligonucleotide
  Description of Combined DNA/RNA Molecule: Synthetic oligonucleotide
cagttgccacttccacataatgtgagt

SEQ ID NO: 3157 - DNA, 27 bp, Artificial Sequence
  Description of Artificial Sequence: Synthetic oligonucleotide
  Description of Combined DNA/RNA Molecule: Synthetic oligonucleotide
atgtgagttcgcatcttgataaggcct

SEQ ID NO: 3158 - DNA, 27 bp, Artificial Sequence
  Description of Artificial Sequence: Synthetic oligonucleotide
  Description of Combined DNA/RNA Molecule: Synthetic oligonucleotide
atgaggcttaccatcagctatttgcgt

SEQ ID NO: 3159 - DNA, 27 bp, Artificial Sequence
  Description of Artificial Sequence: Synthetic oligonucleotide
  Description of Combined DNA/RNA Molecule: Synthetic oligonucleotide
tgaggaaacttctggatgctggtgatt

SEQ ID NO: 3160 - DNA, 27 bp, Artificial Sequence
  Description of Artificial Sequence: Synthetic oligonucleotide
  Description of Combined DNA/RNA Molecule: Synthetic oligonucleotide
tgctggtgatttggatattgaagatga

SEQ ID NO: 3161 - DNA, 27 bp, Artificial Sequence
  Description of Artificial Sequence: Synthetic oligonucleotide
  Description of Combined DNA/RNA Molecule: Synthetic oligonucleotide
ctggtgatttggatattgaagatgaca

SEQ ID NO: 3162 - DNA, 27 bp, Artificial Sequence
  Description of Artificial Sequence: Synthetic oligonucleotide
  Description of Combined DNA/RNA Molecule: Synthetic oligonucleotide
atttggatattgaagatgacatgaaag

SEQ ID NO: 3163 - DNA, 27 bp, Artificial Sequence
  Description of Artificial Sequence: Synthetic oligonucleotide
  Description of Combined DNA/RNA Molecule: Synthetic oligonucleotide
tttggatattgaagatgacatgaaagc

SEQ ID NO: 3164 - DNA, 27 bp, Artificial Sequence
  Description of Artificial Sequence: Synthetic oligonucleotide
  Description of Combined DNA/RNA Molecule: Synthetic oligonucleotide
tggatattgaagatgacatgaaagcac

SEQ ID NO: 3165 - DNA, 27 bp, Artificial Sequence
  Description of Artificial Sequence: Synthetic oligonucleotide
  Description of Combined DNA/RNA Molecule: Synthetic oligonucleotide
ggatattgaagatgacatgaaagcaca

SEQ ID NO: 3166 - DNA, 27 bp, Artificial Sequence
  Description of Artificial Sequence: Synthetic oligonucleotide
  Description of Combined DNA/RNA Molecule: Synthetic oligonucleotide
gaagatgacatgaaagcacagatgaat

SEQ ID NO: 3167 - DNA, 27 bp, Artificial Sequence
  Description of Artificial Sequence: Synthetic oligonucleotide
  Description of Combined DNA/RNA Molecule: Synthetic oligonucleotide
aagatgacatgaaagcacagatgaatt

SEQ ID NO: 3168 - DNA, 27 bp, Artificial Sequence
  Description of Artificial Sequence: Synthetic oligonucleotide
  Description of Combined DNA/RNA Molecule: Synthetic oligonucleotide
tgaaagcacagatgaattgcttttatt

SEQ ID NO: 3169 - DNA, 27 bp, Artificial Sequence
  Description of Artificial Sequence: Synthetic oligonucleotide
  Description of Combined DNA/RNA Molecule: Synthetic oligonucleotide
cacagatgaattgcttttatttgaaag

SEQ ID NO: 3170 - DNA, 27 bp, Artificial Sequence
  Description of Artificial Sequence: Synthetic oligonucleotide
  Description of Combined DNA/RNA Molecule: Synthetic oligonucleotide
acagatgaattgcttttatttgaaagc

SEQ ID NO: 3171 - DNA, 27 bp, Artificial Sequence
  Description of Artificial Sequence: Synthetic oligonucleotide
  Description of Combined DNA/RNA Molecule: Synthetic oligonucleotide
ttttatttgaaagccttggatggtttt

SEQ ID NO: 3172 - DNA, 27 bp, Artificial Sequence
  Description of Artificial Sequence: Synthetic oligonucleotide
  Description of Combined DNA/RNA Molecule: Synthetic oligonucleotide
tttatttgaaagccttggatggttttg

SEQ ID NO: 3173 - DNA, 27 bp, Artificial Sequence
  Description of Artificial Sequence: Synthetic oligonucleotide
  Description of Combined DNA/RNA Molecule: Synthetic oligonucleotide
tgaaagccttggatggttttgttatgg

SEQ ID NO: 3174 - DNA, 27 bp, Artificial Sequence
  Description of Artificial Sequence: Synthetic oligonucleotide
  Description of Combined DNA/RNA Molecule: Synthetic oligonucleotide
gttttgttatggttctcacagatgatg

SEQ ID NO: 3175 - DNA, 27 bp, Artificial Sequence
  Description of Artificial Sequence: Synthetic oligonucleotide
  Description of Combined DNA/RNA Molecule: Synthetic oligonucleotide
ttatggttctcacagatgatggtgaca

SEQ ID NO: 3176 - DNA, 27 bp, Artificial Sequence
  Description of Artificial Sequence: Synthetic oligonucleotide
  Description of Combined DNA/RNA Molecule: Synthetic oligonucleotide
tatggttctcacagatgatggtgacat

SEQ ID NO: 3177 - DNA, 27 bp, Artificial Sequence
  Description of Artificial Sequence: Synthetic oligonucleotide
  Description of Combined DNA/RNA Molecule: Synthetic oligonucleotide
cacagatgatggtgacatgatttacat

SEQ ID NO: 3178 - DNA, 27 bp, Artificial Sequence
  Description of Artificial Sequence: Synthetic oligonucleotide
  Description of Combined DNA/RNA Molecule: Synthetic oligonucleotide
atgatggtgacatgatttacatttctg

SEQ ID NO: 3179 - DNA, 27 bp, Artificial Sequence
  Description of Artificial Sequence: Synthetic oligonucleotide
  Description of Combined DNA/RNA Molecule: Synthetic oligonucleotide
tgatggtgacatgatttacatttctga

SEQ ID NO: 3180 - DNA, 27 bp, Artificial Sequence
  Description of Artificial Sequence: Synthetic oligonucleotide
  Description of Combined DNA/RNA Molecule: Synthetic oligonucleotide
acatgatttacatttctgataatgtga

SEQ ID NO: 3181 - DNA, 27 bp, Artificial Sequence
  Description of Artificial Sequence: Synthetic oligonucleotide
  Description of Combined DNA/RNA Molecule: Synthetic oligonucleotide
atgatttacatttctgataatgtgaac

SEQ ID NO: 3182 - DNA, 27 bp, Artificial Sequence
  Description of Artificial Sequence: Synthetic oligonucleotide
  Description of Combined DNA/RNA Molecule: Synthetic oligonucleotide
gatttacatttctgataatgtgaacaa

SEQ ID NO: 3183 - DNA, 27 bp, Artificial Sequence
  Description of Artificial Sequence: Synthetic oligonucleotide
  Description of Combined DNA/RNA Molecule: Synthetic oligonucleotide
acatttctgataatgtgaacaaataca

SEQ ID NO: 3184 - DNA, 27 bp, Artificial Sequence
  Description of Artificial Sequence: Synthetic oligonucleotide
  Description of Combined DNA/RNA Molecule: Synthetic oligonucleotide
gataatgtgaacaaatacatgggatta

SEQ ID NO: 3185 - DNA, 27 bp, Artificial Sequence
  Description of Artificial Sequence: Synthetic oligonucleotide
  Description of Combined DNA/RNA Molecule: Synthetic oligonucleotide
ataatgtgaacaaatacatgggattaa

SEQ ID NO: 3186 - DNA, 27 bp, Artificial Sequence
  Description of Artificial Sequence: Synthetic oligonucleotide
  Description of Combined DNA/RNA Molecule: Synthetic oligonucleotide
taatgtgaacaaatacatgggattaac

SEQ ID NO: 3187 - DNA, 27 bp, Artificial Sequence
  Description of Artificial Sequence: Synthetic oligonucleotide
  Description of Combined DNA/RNA Molecule: Synthetic oligonucleotide
aatgtgaacaaatacatgggattaact

SEQ ID NO: 3188 - DNA, 27 bp, Artificial Sequence
  Description of Artificial Sequence: Synthetic oligonucleotide
  Description of Combined DNA/RNA Molecule: Synthetic oligonucleotide
atgtgaacaaatacatgggattaactc

SEQ ID NO: 3189 - DNA, 27 bp, Artificial Sequence
  Description of Artificial Sequence: Synthetic oligonucleotide
  Description of Combined DNA/RNA Molecule: Synthetic oligonucleotide
tgtgaacaaatacatgggattaactca

SEQ ID NO: 3190 - DNA, 27 bp, Artificial Sequence
  Description of Artificial Sequence: Synthetic oligonucleotide
  Description of Combined DNA/RNA Molecule: Synthetic oligonucleotide
tacatgggattaactcagtttgaacta

SEQ ID NO: 3191 - DNA, 27 bp, Artificial Sequence
  Description of Artificial Sequence: Synthetic oligonucleotide
  Description of Combined DNA/RNA Molecule: Synthetic oligonucleotide
acatgggattaactcagtttgaactaa

SEQ ID NO: 3192 - DNA, 27 bp, Artificial Sequence
  Description of Artificial Sequence: Synthetic oligonucleotide
  Description of Combined DNA/RNA Molecule: Synthetic oligonucleotide
agtttgaactaactggacacagtgtgt

SEQ ID NO: 3193 - DNA, 27 bp, Artificial Sequence
  Description of Artificial Sequence: Synthetic oligonucleotide
  Description of Combined DNA/RNA Molecule: Synthetic oligonucleotide
aactggacacagtgtgtttgattttac

SEQ ID NO: 3194 - DNA, 27 bp, Artificial Sequence
  Description of Artificial Sequence: Synthetic oligonucleotide
  Description of Combined DNA/RNA Molecule: Synthetic oligonucleotide
actggacacagtgtgtttgattttact

SEQ ID NO: 3195 - DNA, 27 bp, Artificial Sequence
  Description of Artificial Sequence: Synthetic oligonucleotide
  Description of Combined DNA/RNA Molecule: Synthetic oligonucleotide
tgtttgattttactcatccatgtgacc

SEQ ID NO: 3196 - DNA, 27 bp, Artificial Sequence
  Description of Artificial Sequence: Synthetic oligonucleotide
  Description of Combined DNA/RNA Molecule: Synthetic oligonucleotide
tttgattttactcatccatgtgaccat

SEQ ID NO: 3197 - DNA, 27 bp, Artificial Sequence
  Description of Artificial Sequence: Synthetic oligonucleotide
  Description of Combined DNA/RNA Molecule: Synthetic oligonucleotide
tccatgtgaccatgaggaaatgagaga

SEQ ID NO: 3198 - DNA, 27 bp, Artificial Sequence
  Description of Artificial Sequence: Synthetic oligonucleotide
  Description of Combined DNA/RNA Molecule: Synthetic oligonucleotide
catgtgaccatgaggaaatgagagaaa

SEQ ID NO: 3199 - DNA, 27 bp, Artificial Sequence
  Description of Artificial Sequence: Synthetic oligonucleotide
  Description of Combined DNA/RNA Molecule: Synthetic oligonucleotide
accatgaggaaatgagagaaatgctta

SEQ ID NO: 3200 - DNA, 27 bp, Artificial Sequence
  Description of Artificial Sequence: Synthetic oligonucleotide
  Description of Combined DNA/RNA Molecule: Synthetic oligonucleotide
tgagagaaatgcttacacacagaaatg

SEQ ID NO: 3201 - DNA, 27 bp, Artificial Sequence
  Description of Artificial Sequence: Synthetic oligonucleotide
  Description of Combined DNA/RNA Molecule: Synthetic oligonucleotide
agaaatgcttacacacagaaatggcct

SEQ ID NO: 3202 - DNA, 27 bp, Artificial Sequence
  Description of Artificial Sequence: Synthetic oligonucleotide
  Description of Combined DNA/RNA Molecule: Synthetic oligonucleotide
gaaatgcttacacacagaaatggcctt

SEQ ID NO: 3203 - DNA, 27 bp, Artificial Sequence
  Description of Artificial Sequence: Synthetic oligonucleotide
  Description of Combined DNA/RNA Molecule: Synthetic oligonucleotide
cagaaatggccttgtgaaaaagggtaa

SEQ ID NO: 3204 - DNA, 27 bp, Artificial Sequence
  Description of Artificial Sequence: Synthetic oligonucleotide
  Description of Combined DNA/RNA Molecule: Synthetic oligonucleotide
agaaatggccttgtgaaaaagggtaaa

SEQ ID NO: 3205 - DNA, 27 bp, Artificial Sequence
  Description of Artificial Sequence: Synthetic oligonucleotide
  Description of Combined DNA/RNA Molecule: Synthetic oligonucleotide
gaaatggccttgtgaaaaagggtaaag

SEQ ID NO: 3206 - DNA, 27 bp, Artificial Sequence
  Description of Artificial Sequence: Synthetic oligonucleotide
  Description of Combined DNA/RNA Molecule: Synthetic oligonucleotide
aaatggccttgtgaaaaagggtaaaga

SEQ ID NO: 3207 - DNA, 27 bp, Artificial Sequence
  Description of Artificial Sequence: Synthetic oligonucleotide
  Description of Combined DNA/RNA Molecule: Synthetic oligonucleotide
gccttgtgaaaaagggtaaagaacaaa

SEQ ID NO: 3208 - DNA, 27 bp, Artificial Sequence
  Description of Artificial Sequence: Synthetic oligonucleotide
  Description of Combined DNA/RNA Molecule: Synthetic oligonucleotide
taaagaacaaaacacacagcgaagctt

SEQ ID NO: 3209 - DNA, 27 bp, Artificial Sequence
  Description of Artificial Sequence: Synthetic oligonucleotide
  Description of Combined DNA/RNA Molecule: Synthetic oligonucleotide
agcttttttctcagaatgaagtgtacc

SEQ ID NO: 3210 - DNA, 27 bp, Artificial Sequence
  Description of Artificial Sequence: Synthetic oligonucleotide
  Description of Combined DNA/RNA Molecule: Synthetic oligonucleotide
cttttttctcagaatgaagtgtaccct

SEQ ID NO: 3211 - DNA, 27 bp, Artificial Sequence
  Description of Artificial Sequence: Synthetic oligonucleotide
  Description of Combined DNA/RNA Molecule: Synthetic oligonucleotide
agaatgaagtgtaccctaactagccga

SEQ ID NO: 3212 - DNA, 27 bp, Artificial Sequence
  Description of Artificial Sequence: Synthetic oligonucleotide
  Description of Combined DNA/RNA Molecule: Synthetic oligonucleotide
cgaggaagaactatgaacataaagtct

SEQ ID NO: 3213 - DNA, 27 bp, Artificial Sequence
  Description of Artificial Sequence: Synthetic oligonucleotide
  Description of Combined DNA/RNA Molecule: Synthetic oligonucleotide
gaggaagaactatgaacataaagtctg

SEQ ID NO: 3214 - DNA, 27 bp, Artificial Sequence
  Description of Artificial Sequence: Synthetic oligonucleotide
  Description of Combined DNA/RNA Molecule: Synthetic oligonucleotide
aggaagaactatgaacataaagtctgc

SEQ ID NO: 3215 - DNA, 27 bp, Artificial Sequence
  Description of Artificial Sequence: Synthetic oligonucleotide
  Description of Combined DNA/RNA Molecule: Synthetic oligonucleotide
cacaggccacattcacgtatatgatac

SEQ ID NO: 3216 - DNA, 27 bp, Artificial Sequence
  Description of Artificial Sequence: Synthetic oligonucleotide
  Description of Combined DNA/RNA Molecule: Synthetic oligonucleotide
tgtgggtataagaaaccacctatgacc

SEQ ID NO: 3217 - DNA, 27 bp, Artificial Sequence
  Description of Artificial Sequence: Synthetic oligonucleotide
  Description of Combined DNA/RNA Molecule: Synthetic oligonucleotide
gtgggtataagaaaccacctatgacct

SEQ ID NO: 3218 - DNA, 27 bp, Artificial Sequence
  Description of Artificial Sequence: Synthetic oligonucleotide
  Description of Combined DNA/RNA Molecule: Synthetic oligonucleotide
aaatattgaaattcctttagatagcaa

SEQ ID NO: 3219 - DNA, 27 bp, Artificial Sequence
  Description of Artificial Sequence: Synthetic oligonucleotide
  Description of Combined DNA/RNA Molecule: Synthetic oligonucleotide
tgaaattcctttagatagcaagacttt

SEQ ID NO: 3220 - DNA, 27 bp, Artificial Sequence
  Description of Artificial Sequence: Synthetic oligonucleotide
  Description of Combined DNA/RNA Molecule: Synthetic oligonucleotide
tggatatgaaattttcttattgtgatg

SEQ ID NO: 3221 - DNA, 27 bp, Artificial Sequence
  Description of Artificial Sequence: Synthetic oligonucleotide
  Description of Combined DNA/RNA Molecule: Synthetic oligonucleotide
atatgaaattttcttattgtgatgaaa

SEQ ID NO: 3222 - DNA, 27 bp, Artificial Sequence
  Description of Artificial Sequence: Synthetic oligonucleotide
  Description of Combined DNA/RNA Molecule: Synthetic oligonucleotide
tatgaaattttcttattgtgatgaaag

SEQ ID NO: 3223 - DNA, 27 bp, Artificial Sequence
  Description of Artificial Sequence: Synthetic oligonucleotide
  Description of Combined DNA/RNA Molecule: Synthetic oligonucleotide
atgaaattttcttattgtgatgaaaga

SEQ ID NO: 3224 - DNA, 27 bp, Artificial Sequence
  Description of Artificial Sequence: Synthetic oligonucleotide
  Description of Combined DNA/RNA Molecule: Synthetic oligonucleotide
gaaattttcttattgtgatgaaagaat

SEQ ID NO: 3225 - DNA, 27 bp, Artificial Sequence
  Description of Artificial Sequence: Synthetic oligonucleotide
  Description of Combined DNA/RNA Molecule: Synthetic oligonucleotide
aaattttcttattgtgatgaaagaatt

SEQ ID NO: 3226 - DNA, 27 bp, Artificial Sequence
  Description of Artificial Sequence: Synthetic oligonucleotide
  Description of Combined DNA/RNA Molecule: Synthetic oligonucleotide
aattttcttattgtgatgaaagaatta

SEQ ID NO: 3227 - DNA, 27 bp, Artificial Sequence
  Description of Artificial Sequence: Synthetic oligonucleotide
  Description of Combined DNA/RNA Molecule: Synthetic oligonucleotide
ttcttattgtgatgaaagaattaccga

SEQ ID NO: 3228 - DNA, 27 bp, Artificial Sequence
  Description of Artificial Sequence: Synthetic oligonucleotide
  Description of Combined DNA/RNA Molecule: Synthetic oligonucleotide
attgtgatgaaagaattaccgaattga

SEQ ID NO: 3229 - DNA, 27 bp, Artificial Sequence
  Description of Artificial Sequence: Synthetic oligonucleotide
  Description of Combined DNA/RNA Molecule: Synthetic oligonucleotide
tgtgatgaaagaattaccgaattgatg

SEQ ID NO: 3230 - DNA, 27 bp, Artificial Sequence
  Description of Artificial Sequence: Synthetic oligonucleotide
  Description of Combined DNA/RNA Molecule: Synthetic oligonucleotide
tgaaagaattaccgaattgatgggata

SEQ ID NO: 3231 - DNA, 27 bp, Artificial Sequence
  Description of Artificial Sequence: Synthetic oligonucleotide
  Description of Combined DNA/RNA Molecule: Synthetic oligonucleotide
gaaagaattaccgaattgatgggatat

SEQ ID NO: 3232 - DNA, 27 bp, Artificial Sequence
  Description of Artificial Sequence: Synthetic oligonucleotide
  Description of Combined DNA/RNA Molecule: Synthetic oligonucleotide
aaagaattaccgaattgatgggatatg

SEQ ID NO: 3233 - DNA, 27 bp, Artificial Sequence
  Description of Artificial Sequence: Synthetic oligonucleotide
  Description of Combined DNA/RNA Molecule: Synthetic oligonucleotide
aagaattaccgaattgatgggatatga

SEQ ID NO: 3234 - DNA, 27 bp, Artificial Sequence
  Description of Artificial Sequence: Synthetic oligonucleotide
  Description of Combined DNA/RNA Molecule: Synthetic oligonucleotide
tgatgggatatgagccagaagaacttt

SEQ ID NO: 3235 - DNA, 27 bp, Artificial Sequence
  Description of Artificial Sequence: Synthetic oligonucleotide
  Description of Combined DNA/RNA Molecule: Synthetic oligonucleotide
atatgagccagaagaacttttaggccg

SEQ ID NO: 3236 - DNA, 27 bp, Artificial Sequence
  Description of Artificial Sequence: Synthetic oligonucleotide
  Description of Combined DNA/RNA Molecule: Synthetic oligonucleotide
tttaggccgctcaatttatgaatatta

SEQ ID NO: 3237 - DNA, 27 bp, Artificial Sequence
  Description of Artificial Sequence: Synthetic oligonucleotide
  Description of Combined DNA/RNA Molecule: Synthetic oligonucleotide
tttatgaatattatcatgctttggact

SEQ ID NO: 3238 - DNA, 27 bp, Artificial Sequence
  Description of Artificial Sequence: Synthetic oligonucleotide
  Description of Combined DNA/RNA Molecule: Synthetic oligonucleotide
tatgaatattatcatgctttggactct

SEQ ID NO: 3239 - DNA, 27 bp, Artificial Sequence
  Description of Artificial Sequence: Synthetic oligonucleotide
  Description of Combined DNA/RNA Molecule: Synthetic oligonucleotide
atctgaccaaaactcatcatgatatgt

SEQ ID NO: 3240 - DNA, 27 bp, Artificial Sequence
  Description of Artificial Sequence: Synthetic oligonucleotide
  Description of Combined DNA/RNA Molecule: Synthetic oligonucleotide
accaaaactcatcatgatatgtttact

SEQ ID NO: 3241 - DNA, 27 bp, Artificial Sequence
  Description of Artificial Sequence: Synthetic oligonucleotide
  Description of Combined DNA/RNA Molecule: Synthetic oligonucleotide
ccaaaactcatcatgatatgtttacta

SEQ ID NO: 3242 - DNA, 27 bp, Artificial Sequence
  Description of Artificial Sequence: Synthetic oligonucleotide
  Description of Combined DNA/RNA Molecule: Synthetic oligonucleotide
atcatgatatgtttactaaaggacaag

SEQ ID NO: 3243 - DNA, 27 bp, Artificial Sequence
  Description of Artificial Sequence: Synthetic oligonucleotide
  Description of Combined DNA/RNA Molecule: Synthetic oligonucleotide
tgatatgtttactaaaggacaagtcac

SEQ ID NO: 3244 - DNA, 27 bp, Artificial Sequence
  Description of Artificial Sequence: Synthetic oligonucleotide
  Description of Combined DNA/RNA Molecule: Synthetic oligonucleotide
gaggtggatatgtctgggttgaaactc

SEQ ID NO: 3245 - DNA, 27 bp, Artificial Sequence
  Description of Artificial Sequence: Synthetic oligonucleotide
  Description of Combined DNA/RNA Molecule: Synthetic oligonucleotide
tgggttgaaactcaagcaactgtcata

SEQ ID NO: 3246 - DNA, 27 bp, Artificial Sequence
  Description of Artificial Sequence: Synthetic oligonucleotide
  Description of Combined DNA/RNA Molecule: Synthetic oligonucleotide
aactgtcatatataacaccaagaattc

SEQ ID NO: 3247 - DNA, 27 bp, Artificial Sequence
  Description of Artificial Sequence: Synthetic oligonucleotide
  Description of Combined DNA/RNA Molecule: Synthetic oligonucleotide
accaagaattctcaaccacagtgcatt

SEQ ID NO: 3248 - DNA, 27 bp, Artificial Sequence
  Description of Artificial Sequence: Synthetic oligonucleotide
  Description of Combined DNA/RNA Molecule: Synthetic oligonucleotide
cacagtgcattgtatgtgtgaattacg

SEQ ID NO: 3249 - DNA, 27 bp, Artificial Sequence
  Description of Artificial Sequence: Synthetic oligonucleotide
  Description of Combined DNA/RNA Molecule: Synthetic oligonucleotide
acagtgcattgtatgtgtgaattacgt

SEQ ID NO: 3250 - DNA, 27 bp, Artificial Sequence
  Description of Artificial Sequence: Synthetic oligonucleotide
  Description of Combined DNA/RNA Molecule: Synthetic oligonucleotide
atgtgtgaattacgttgtgagtggtat

SEQ ID NO: 3251 - DNA, 27 bp, Artificial Sequence
  Description of Artificial Sequence: Synthetic oligonucleotide
  Description of Combined DNA/RNA Molecule: Synthetic oligonucleotide
tgtgtgaattacgttgtgagtggtatt

SEQ ID NO: 3252 - DNA, 27 bp, Artificial Sequence
  Description of Artificial Sequence: Synthetic oligonucleotide
  Description of Combined DNA/RNA Molecule: Synthetic oligonucleotide
gtgtgaattacgttgtgagtggtatta

SEQ ID NO: 3253 - DNA, 27 bp, Artificial Sequence
  Description of Artificial Sequence: Synthetic oligonucleotide
  Description of Combined DNA/RNA Molecule: Synthetic oligonucleotide
tgtgaattacgttgtgagtggtattat

SEQ ID NO: 3254 - DNA, 27 bp, Artificial Sequence
  Description of Artificial Sequence: Synthetic oligonucleotide
  Description of Combined DNA/RNA Molecule: Synthetic oligonucleotide
tggtattattcagcacgacttgatttt

SEQ ID NO: 3255 - DNA, 27 bp, Artificial Sequence
  Description of Artificial Sequence: Synthetic oligonucleotide
  Description of Combined DNA/RNA Molecule: Synthetic oligonucleotide
cttgattttctcccttcaacaaacaga

SEQ ID NO: 3256 - DNA, 27 bp, Artificial Sequence
  Description of Artificial Sequence: Synthetic oligonucleotide
  Description of Combined DNA/RNA Molecule: Synthetic oligonucleotide
aacaaacagaatgtgtccttaaaccgg

SEQ ID NO: 3257 - DNA, 27 bp, Artificial Sequence
  Description of Artificial Sequence: Synthetic oligonucleotide
  Description of Combined DNA/RNA Molecule: Synthetic oligonucleotide
aatgtgtccttaaaccggttgaatctt

SEQ ID NO: 3258 - DNA, 27 bp, Artificial Sequence
  Description of Artificial Sequence: Synthetic oligonucleotide
  Description of Combined DNA/RNA Molecule: Synthetic oligonucleotide
accggttgaatcttcagatatgaaaat

SEQ ID NO: 3259 - DNA, 27 bp, Artificial Sequence
  Description of Artificial Sequence: Synthetic oligonucleotide
  Description of Combined DNA/RNA Molecule: Synthetic oligonucleotide
ccggttgaatcttcagatatgaaaatg

SEQ ID NO: 3260 - DNA, 27 bp, Artificial Sequence
  Description of Artificial Sequence: Synthetic oligonucleotide
  Description of Combined DNA/RNA Molecule: Synthetic oligonucleotide
cggttgaatcttcagatatgaaaatga

SEQ ID NO: 3261 - DNA, 27 bp, Artificial Sequence
  Description of Artificial Sequence: Synthetic oligonucleotide
  Description of Combined DNA/RNA Molecule: Synthetic oligonucleotide
gttgaatcttcagatatgaaaatgact

SEQ ID NO: 3262 - DNA, 27 bp, Artificial Sequence
  Description of Artificial Sequence: Synthetic oligonucleotide
  Description of Combined DNA/RNA Molecule: Synthetic oligonucleotide
ttgaatcttcagatatgaaaatgactc

SEQ ID NO: 3263 - DNA, 27 bp, Artificial Sequence
  Description of Artificial Sequence: Synthetic oligonucleotide
  Description of Combined DNA/RNA Molecule: Synthetic oligonucleotide
agatatgaaaatgactcagctattcac

SEQ ID NO: 3264 - DNA, 27 bp, Artificial Sequence
  Description of Artificial Sequence: Synthetic oligonucleotide
  Description of Combined DNA/RNA Molecule: Synthetic oligonucleotide
gatatgaaaatgactcagctattcacc

SEQ ID NO: 3265 - DNA, 27 bp, Artificial Sequence
  Description of Artificial Sequence: Synthetic oligonucleotide
  Description of Combined DNA/RNA Molecule: Synthetic oligonucleotide
aaagttgaatcagaagatacaagtagc

SEQ ID NO: 3266 - DNA, 27 bp, Artificial Sequence
  Description of Artificial Sequence: Synthetic oligonucleotide
  Description of Combined DNA/RNA Molecule: Synthetic oligonucleotide
agttgaatcagaagatacaagtagcct

SEQ ID NO: 3267 - DNA, 27 bp, Artificial Sequence
  Description of Artificial Sequence: Synthetic oligonucleotide
  Description of Combined DNA/RNA Molecule: Synthetic oligonucleotide
cagaagatacaagtagcctctttgaca

SEQ ID NO: 3268 - DNA, 27 bp, Artificial Sequence
  Description of Artificial Sequence: Synthetic oligonucleotide
  Description of Combined DNA/RNA Molecule: Synthetic oligonucleotide
agaagatacaagtagcctctttgacaa

SEQ ID NO: 3269 - DNA, 27 bp, Artificial Sequence
  Description of Artificial Sequence: Synthetic oligonucleotide
  Description of Combined DNA/RNA Molecule: Synthetic oligonucleotide
gaagatacaagtagcctctttgacaaa

SEQ ID NO: 3270 - DNA, 27 bp, Artificial Sequence
  Description of Artificial Sequence: Synthetic oligonucleotide
  Description of Combined DNA/RNA Molecule: Synthetic oligonucleotide
ctctttgacaaacttaagaaggaacct

SEQ ID NO: 3271 - DNA, 27 bp, Artificial Sequence
  Description of Artificial Sequence: Synthetic oligonucleotide
  Description of Combined DNA/RNA Molecule: Synthetic oligonucleotide
tctttgacaaacttaagaaggaacctg

SEQ ID NO: 3272 - DNA, 27 bp, Artificial Sequence
  Description of Artificial Sequence: Synthetic oligonucleotide
  Description of Combined DNA/RNA Molecule: Synthetic oligonucleotide
acctgatgctttaactttgctggcccc

SEQ ID NO: 3273 - DNA, 27 bp, Artificial Sequence
  Description of Artificial Sequence: Synthetic oligonucleotide
  Description of Combined DNA/RNA Molecule: Synthetic oligonucleotide
ctggagacacaatcatatctttagatt

SEQ ID NO: 3274 - DNA, 27 bp, Artificial Sequence
  Description of Artificial Sequence: Synthetic oligonucleotide
  Description of Combined DNA/RNA Molecule: Synthetic oligonucleotide
tggagacacaatcatatctttagattt

SEQ ID NO: 3275 - DNA, 27 bp, Artificial Sequence
  Description of Artificial Sequence: Synthetic oligonucleotide
  Description of Combined DNA/RNA Molecule: Synthetic oligonucleotide
aacttgaggaagtaccattatataatg

SEQ ID NO: 3276 - DNA, 27 bp, Artificial Sequence
  Description of Artificial Sequence: Synthetic oligonucleotide
  Description of Combined DNA/RNA Molecule: Synthetic oligonucleotide
acttgaggaagtaccattatataatga

SEQ ID NO: 3277 - DNA, 27 bp, Artificial Sequence
  Description of Artificial Sequence: Synthetic oligonucleotide
  Description of Combined DNA/RNA Molecule: Synthetic oligonucleotide
ttgaggaagtaccattatataatgatg

SEQ ID NO: 3278 - DNA, 27 bp, Artificial Sequence
  Description of Artificial Sequence: Synthetic oligonucleotide
  Description of Combined DNA/RNA Molecule: Synthetic oligonucleotide
tgaggaagtaccattatataatgatgt

SEQ ID NO: 3279 - DNA, 27 bp, Artificial Sequence
  Description of Artificial Sequence: Synthetic oligonucleotide
  Description of Combined DNA/RNA Molecule: Synthetic oligonucleotide
aggaagtaccattatataatgatgtaa

SEQ ID NO: 3280 - DNA, 27 bp, Artificial Sequence
  Description of Artificial Sequence: Synthetic oligonucleotide
  Description of Combined DNA/RNA Molecule: Synthetic oligonucleotide
ggaagtaccattatataatgatgtaat

SEQ ID NO: 3281 - DNA, 27 bp, Artificial Sequence
  Description of Artificial Sequence: Synthetic oligonucleotide
  Description of Combined DNA/RNA Molecule: Synthetic oligonucleotide
aacgaaaaattacagaatataaatttg

SEQ ID NO: 3282 - DNA, 27 bp, Artificial Sequence
  Description of Artificial Sequence: Synthetic oligonucleotide
  Description of Combined DNA/RNA Molecule: Synthetic oligonucleotide
acgaaaaattacagaatataaatttgg

SEQ ID NO: 3283 - DNA, 27 bp, Artificial Sequence
  Description of Artificial Sequence: Synthetic oligonucleotide
  Description of Combined DNA/RNA Molecule: Synthetic oligonucleotide
aaaaattacagaatataaatttggcaa

SEQ ID NO: 3284 - DNA, 27 bp, Artificial Sequence
  Description of Artificial Sequence: Synthetic oligonucleotide
  Description of Combined DNA/RNA Molecule: Synthetic oligonucleotide
tacagaatataaatttggcaatgtctc

SEQ ID NO: 3285 - DNA, 27 bp, Artificial Sequence
  Description of Artificial Sequence: Synthetic oligonucleotide
  Description of Combined DNA/RNA Molecule: Synthetic oligonucleotide
acagaatataaatttggcaatgtctcc

SEQ ID NO: 3286 - DNA, 27 bp, Artificial Sequence
  Description of Artificial Sequence: Synthetic oligonucleotide
  Description of Combined DNA/RNA Molecule: Synthetic oligonucleotide
atcaagaagttgcattaaaattagaac

SEQ ID NO: 3287 - DNA, 27 bp, Artificial Sequence
  Description of Artificial Sequence: Synthetic oligonucleotide
  Description of Combined DNA/RNA Molecule: Synthetic oligonucleotide
tcaagaagttgcattaaaattagaacc

SEQ ID NO: 3288 - DNA, 27 bp, Artificial Sequence
  Description of Artificial Sequence: Synthetic oligonucleotide
  Description of Combined DNA/RNA Molecule: Synthetic oligonucleotide
taaaattagaaccaaatccagagtcac

SEQ ID NO: 3289 - DNA, 27 bp, Artificial Sequence
  Description of Artificial Sequence: Synthetic oligonucleotide
  Description of Combined DNA/RNA Molecule: Synthetic oligonucleotide
aaaattagaaccaaatccagagtcact

SEQ ID NO: 3290 - DNA, 27 bp, Artificial Sequence
  Description of Artificial Sequence: Synthetic oligonucleotide
  Description of Combined DNA/RNA Molecule: Synthetic oligonucleotide
ccagagtcactggaactttcttttacc

SEQ ID NO: 3291 - DNA, 27 bp, Artificial Sequence
  Description of Artificial Sequence: Synthetic oligonucleotide
  Description of Combined DNA/RNA Molecule: Synthetic oligonucleotide
cagagtcactggaactttcttttacca

SEQ ID NO: 3292 - DNA, 27 bp, Artificial Sequence
  Description of Artificial Sequence: Synthetic oligonucleotide
  Description of Combined DNA/RNA Molecule: Synthetic oligonucleotide
cactggaactttcttttaccatgcccc

SEQ ID NO: 3293 - DNA, 27 bp, Artificial Sequence
  Description of Artificial Sequence: Synthetic oligonucleotide
  Description of Combined DNA/RNA Molecule: Synthetic oligonucleotide
gcctaatagtcccagtgaatattgttt

SEQ ID NO: 3294 - DNA, 27 bp, Artificial Sequence
  Description of Artificial Sequence: Synthetic oligonucleotide
  Description of Combined DNA/RNA Molecule: Synthetic oligonucleotide
cctaatagtcccagtgaatattgtttt

SEQ ID NO: 3295 - DNA, 27 bp, Artificial Sequence
  Description of Artificial Sequence: Synthetic oligonucleotide
  Description of Combined DNA/RNA Molecule: Synthetic oligonucleotide
ctaatagtcccagtgaatattgttttt

SEQ ID NO: 3296 - DNA, 27 bp, Artificial Sequence
  Description of Artificial Sequence: Synthetic oligonucleotide
  Description of Combined DNA/RNA Molecule: Synthetic oligonucleotide
taatagtcccagtgaatattgttttta

SEQ ID NO: 3297 - DNA, 27 bp, Artificial Sequence
  Description of Artificial Sequence: Synthetic oligonucleotide
  Description of Combined DNA/RNA Molecule: Synthetic oligonucleotide
aatagtcccagtgaatattgtttttat

SEQ ID NO: 3298 - DNA, 27 bp, Artificial Sequence
  Description of Artificial Sequence: Synthetic oligonucleotide
  Description of Combined DNA/RNA Molecule: Synthetic oligonucleotide
cagtgaatattgtttttatgtggatag

SEQ ID NO: 3299 - DNA, 27 bp, Artificial Sequence
  Description of Artificial Sequence: Synthetic oligonucleotide
  Description of Combined DNA/RNA Molecule: Synthetic oligonucleotide
agtgaatattgtttttatgtggatagt

SEQ ID NO: 3300 - DNA, 27 bp, Artificial Sequence
  Description of Artificial Sequence: Synthetic oligonucleotide
  Description of Combined DNA/RNA Molecule: Synthetic oligonucleotide
tgaatattgtttttatgtggatagtga

SEQ ID NO: 3301 - DNA, 27 bp, Artificial Sequence
  Description of Artificial Sequence: Synthetic oligonucleotide
  Description of Combined DNA/RNA Molecule: Synthetic oligonucleotide
aatattgtttttatgtggatagtgata

SEQ ID NO: 3302 - DNA, 27 bp, Artificial Sequence
  Description of Artificial Sequence: Synthetic oligonucleotide
  Description of Combined DNA/RNA Molecule: Synthetic oligonucleotide
atattgtttttatgtggatagtgatat

SEQ ID NO: 3303 - DNA, 27 bp, Artificial Sequence
  Description of Artificial Sequence: Synthetic oligonucleotide
  Description of Combined DNA/RNA Molecule: Synthetic oligonucleotide
attgtttttatgtggatagtgatatgg

SEQ ID NO: 3304 - DNA, 27 bp, Artificial Sequence
  Description of Artificial Sequence: Synthetic oligonucleotide
  Description of Combined DNA/RNA Molecule: Synthetic oligonucleotide
gtttttatgtggatagtgatatggtca

SEQ ID NO: 3305 - DNA, 27 bp, Artificial Sequence
  Description of Artificial Sequence: Synthetic oligonucleotide
  Description of Combined DNA/RNA Molecule: Synthetic oligonucleotide
tgtggatagtgatatggtcaatgaatt

SEQ ID NO: 3306 - DNA, 27 bp, Artificial Sequence
  Description of Artificial Sequence: Synthetic oligonucleotide
  Description of Combined DNA/RNA Molecule: Synthetic oligonucleotide
tggatagtgatatggtcaatgaattca

SEQ ID NO: 3307 - DNA, 27 bp, Artificial Sequence
  Description of Artificial Sequence: Synthetic oligonucleotide
  Description of Combined DNA/RNA Molecule: Synthetic oligonucleotide
ggatagtgatatggtcaatgaattcaa

SEQ ID NO: 3308 - DNA, 27 bp, Artificial Sequence
  Description of Artificial Sequence: Synthetic oligonucleotide
  Description of Combined DNA/RNA Molecule: Synthetic oligonucleotide
gatagtgatatggtcaatgaattcaag

SEQ ID NO: 3309 - DNA, 27 bp, Artificial Sequence
  Description of Artificial Sequence: Synthetic oligonucleotide
  Description of Combined DNA/RNA Molecule: Synthetic oligonucleotide
gtgatatggtcaatgaattcaagttgg

SEQ ID NO: 3310 - DNA, 27 bp, Artificial Sequence
  Description of Artificial Sequence: Synthetic oligonucleotide
  Description of Combined DNA/RNA Molecule: Synthetic oligonucleotide
atatggtcaatgaattcaagttggaat

SEQ ID NO: 3311 - DNA, 27 bp, Artificial Sequence
  Description of Artificial Sequence: Synthetic oligonucleotide
  Description of Combined DNA/RNA Molecule: Synthetic oligonucleotide
tatggtcaatgaattcaagttggaatt

SEQ ID NO: 3312 - DNA, 27 bp, Artificial Sequence
  Description of Artificial Sequence: Synthetic oligonucleotide
  Description of Combined DNA/RNA Molecule: Synthetic oligonucleotide
tcaatgaattcaagttggaattggtag

SEQ ID NO: 3313 - DNA, 27 bp, Artificial Sequence
  Description of Artificial Sequence: Synthetic oligonucleotide
  Description of Combined DNA/RNA Molecule: Synthetic oligonucleotide
caatgaattcaagttggaattggtaga

SEQ ID NO: 3314 - DNA, 27 bp, Artificial Sequence
  Description of Artificial Sequence: Synthetic oligonucleotide
  Description of Combined DNA/RNA Molecule: Synthetic oligonucleotide
atgaattcaagttggaattggtagaaa

SEQ ID NO: 3315 - DNA, 27 bp, Artificial Sequence
  Description of Artificial Sequence: Synthetic oligonucleotide
  Description of Combined DNA/RNA Molecule: Synthetic oligonucleotide
tcaagttggaattggtagaaaaacttt

SEQ ID NO: 3316 - DNA, 27 bp, Artificial Sequence
  Description of Artificial Sequence: Synthetic oligonucleotide
  Description of Combined DNA/RNA Molecule: Synthetic oligonucleotide
tggaattggtagaaaaactttttgctg

SEQ ID NO: 3317 - DNA, 27 bp, Artificial Sequence
  Description of Artificial Sequence: Synthetic oligonucleotide
  Description of Combined DNA/RNA Molecule: Synthetic oligonucleotide
ggaattggtagaaaaactttttgctga

SEQ ID NO: 3318 - DNA, 27 bp, Artificial Sequence
  Description of Artificial Sequence: Synthetic oligonucleotide
  Description of Combined DNA/RNA Molecule: Synthetic oligonucleotide
ggtagaaaaactttttgctgaagacac

SEQ ID NO: 3319 - DNA, 27 bp, Artificial Sequence
  Description of Artificial Sequence: Synthetic oligonucleotide
  Description of Combined DNA/RNA Molecule: Synthetic oligonucleotide
gtagaaaaactttttgctgaagacaca

SEQ ID NO: 3320 - DNA, 27 bp, Artificial Sequence
  Description of Artificial Sequence: Synthetic oligonucleotide
  Description of Combined DNA/RNA Molecule: Synthetic oligonucleotide
aactttttgctgaagacacagaagcaa

SEQ ID NO: 3321 - DNA, 27 bp, Artificial Sequence
  Description of Artificial Sequence: Synthetic oligonucleotide
  Description of Combined DNA/RNA Molecule: Synthetic oligonucleotide
tgctgaagacacagaagcaaagaaccc

SEQ ID NO: 3322 - DNA, 27 bp, Artificial Sequence
  Description of Artificial Sequence: Synthetic oligonucleotide
  Description of Combined DNA/RNA Molecule: Synthetic oligonucleotide
gctgaagacacagaagcaaagaaccca

SEQ ID NO: 3323 - DNA, 27 bp, Artificial Sequence
  Description of Artificial Sequence: Synthetic oligonucleotide
  Description of Combined DNA/RNA Molecule: Synthetic oligonucleotide
cacagaagcaaagaacccattttctac

SEQ ID NO: 3324 - DNA, 27 bp, Artificial Sequence
  Description of Artificial Sequence: Synthetic oligonucleotide
  Description of Combined DNA/RNA Molecule: Synthetic oligonucleotide
aaagaacccattttctactcaggacac

SEQ ID NO: 3325 - DNA, 27 bp, Artificial Sequence
  Description of Artificial Sequence: Synthetic oligonucleotide
  Description of Combined DNA/RNA Molecule: Synthetic oligonucleotide
ctcaggacacagatttagacttggaga

SEQ ID NO: 3326 - DNA, 27 bp, Artificial Sequence
  Description of Artificial Sequence: Synthetic oligonucleotide
  Description of Combined DNA/RNA Molecule: Synthetic oligonucleotide
cacagatttagacttggagatgttagc

SEQ ID NO: 3327 - DNA, 27 bp, Artificial Sequence
  Description of Artificial Sequence: Synthetic oligonucleotide
  Description of Combined DNA/RNA Molecule: Synthetic oligonucleotide
cagatttagacttggagatgttagctc

SEQ ID NO: 3328 - DNA, 27 bp, Artificial Sequence
  Description of Artificial Sequence: Synthetic oligonucleotide
  Description of Combined DNA/RNA Molecule: Synthetic oligonucleotide
agatttagacttggagatgttagctcc

SEQ ID NO: 3329 - DNA, 27 bp, Artificial Sequence
  Description of Artificial Sequence: Synthetic oligonucleotide
  Description of Combined DNA/RNA Molecule: Synthetic oligonucleotide
ttggagatgttagctccctatatccca

SEQ ID NO: 3330 - DNA, 27 bp, Artificial Sequence
  Description of Artificial Sequence: Synthetic oligonucleotide
  Description of Combined DNA/RNA Molecule: Synthetic oligonucleotide
ggatgatgacttccagttacgttcctt

SEQ ID NO: 3331 - DNA, 27 bp, Artificial Sequence
  Description of Artificial Sequence: Synthetic oligonucleotide
  Description of Combined DNA/RNA Molecule: Synthetic oligonucleotide
ttcgatcagttgtcaccattagaaagc

SEQ ID NO: 3332 - DNA, 27 bp, Artificial Sequence
  Description of Artificial Sequence: Synthetic oligonucleotide
  Description of Combined DNA/RNA Molecule: Synthetic oligonucleotide
agttgtcaccattagaaagcagttccg

SEQ ID NO: 3333 - DNA, 27 bp, Artificial Sequence
  Description of Artificial Sequence: Synthetic oligonucleotide
  Description of Combined DNA/RNA Molecule: Synthetic oligonucleotide
cacagttacagtattccagcagactca

SEQ ID NO: 3334 - DNA, 27 bp, Artificial Sequence
  Description of Artificial Sequence: Synthetic oligonucleotide
  Description of Combined DNA/RNA Molecule: Synthetic oligonucleotide
atgaattaaaaacagtgacaaaagacc

SEQ ID NO: 3335 - DNA, 27 bp, Artificial Sequence
  Description of Artificial Sequence: Synthetic oligonucleotide
  Description of Combined DNA/RNA Molecule: Synthetic oligonucleotide
tgaattaaaaacagtgacaaaagaccg

SEQ ID NO: 3336 - DNA, 27 bp, Artificial Sequence
  Description of Artificial Sequence: Synthetic oligonucleotide
  Description of Combined DNA/RNA Molecule: Synthetic oligonucleotide
gaattaaaaacagtgacaaaagaccgt

SEQ ID NO: 3337 - DNA, 27 bp, Artificial Sequence
  Description of Artificial Sequence: Synthetic oligonucleotide
  Description of Combined DNA/RNA Molecule: Synthetic oligonucleotide
aacagtgacaaaagaccgtatggaaga

SEQ ID NO: 3338 - DNA, 27 bp, Artificial Sequence
  Description of Artificial Sequence: Synthetic oligonucleotide
  Description of Combined DNA/RNA Molecule: Synthetic oligonucleotide
cagtgacaaaagaccgtatggaagaca

SEQ ID NO: 3339 - DNA, 27 bp, Artificial Sequence
  Description of Artificial Sequence: Synthetic oligonucleotide
  Description of Combined DNA/RNA Molecule: Synthetic oligonucleotide
accgtatggaagacattaaaatattga

SEQ ID NO: 3340 - DNA, 27 bp, Artificial Sequence
  Description of Artificial Sequence: Synthetic oligonucleotide
  Description of Combined DNA/RNA Molecule: Synthetic oligonucleotide
gtatggaagacattaaaatattgattg

SEQ ID NO: 3341 - DNA, 27 bp, Artificial Sequence
  Description of Artificial Sequence: Synthetic oligonucleotide
  Description of Combined DNA/RNA Molecule: Synthetic oligonucleotide
tatggaagacattaaaatattgattgc

SEQ ID NO: 3342 - DNA, 27 bp, Artificial Sequence
  Description of Artificial Sequence: Synthetic oligonucleotide
  Description of Combined DNA/RNA Molecule: Synthetic oligonucleotide
tggaagacattaaaatattgattgcat

SEQ ID NO: 3343 - DNA, 27 bp, Artificial Sequence
  Description of Artificial Sequence: Synthetic oligonucleotide
  Description of Combined DNA/RNA Molecule: Synthetic oligonucleotide
atatagagatactcaaagtcggacagc

SEQ ID NO: 3344 - DNA, 27 bp, Artificial Sequence
  Description of Artificial Sequence: Synthetic oligonucleotide
  Description of Combined DNA/RNA Molecule: Synthetic oligonucleotide
aggaaaaggagtcatagaacagacaga

SEQ ID NO: 3345 - DNA, 27 bp, Artificial Sequence
  Description of Artificial Sequence: Synthetic oligonucleotide
  Description of Combined DNA/RNA Molecule: Synthetic oligonucleotide
aaaggagtcatagaacagacagaaaaa

SEQ ID NO: 3346 - DNA, 27 bp, Artificial Sequence
  Description of Artificial Sequence: Synthetic oligonucleotide
  Description of Combined DNA/RNA Molecule: Synthetic oligonucleotide
aaggagtcatagaacagacagaaaaat

SEQ ID NO: 3347 - DNA, 27 bp, Artificial Sequence
  Description of Artificial Sequence: Synthetic oligonucleotide
  Description of Combined DNA/RNA Molecule: Synthetic oligonucleotide
gacagaaaaatctcatccaagaagccc

SEQ ID NO: 3348 - DNA, 27 bp, Artificial Sequence
  Description of Artificial Sequence: Synthetic oligonucleotide
  Description of Combined DNA/RNA Molecule: Synthetic oligonucleotide
acagaaaaatctcatccaagaagccct

SEQ ID NO: 3349 - DNA, 27 bp, Artificial Sequence
  Description of Artificial Sequence: Synthetic oligonucleotide
  Description of Combined DNA/RNA Molecule: Synthetic oligonucleotide
aacgtgttatctgtcgctttgagtcaa

SEQ ID NO: 3350 - DNA, 27 bp, Artificial Sequence
  Description of Artificial Sequence: Synthetic oligonucleotide
  Description of Combined DNA/RNA Molecule: Synthetic oligonucleotide
acgtgttatctgtcgctttgagtcaaa

SEQ ID NO: 3351 - DNA, 27 bp, Artificial Sequence
  Description of Artificial Sequence: Synthetic oligonucleotide
  Description of Combined DNA/RNA Molecule: Synthetic oligonucleotide
atctgtcgctttgagtcaaagaactac

SEQ ID NO: 3352 - DNA, 27 bp, Artificial Sequence
  Description of Artificial Sequence: Synthetic oligonucleotide
  Description of Combined DNA/RNA Molecule: Synthetic oligonucleotide
gctttgagtcaaagaactacagttcct

SEQ ID NO: 3353 - DNA, 27 bp, Artificial Sequence
  Description of Artificial Sequence: Synthetic oligonucleotide
  Description of Combined DNA/RNA Molecule: Synthetic oligonucleotide
ctttgagtcaaagaactacagttcctg

SEQ ID NO: 3354 - DNA, 27 bp, Artificial Sequence
  Description of Artificial Sequence: Synthetic oligonucleotide
  Description of Combined DNA/RNA Molecule: Synthetic oligonucleotide
gtcaaagaactacagttcctgaggaag

SEQ ID NO: 3355 - DNA, 27 bp, Artificial Sequence
  Description of Artificial Sequence: Synthetic oligonucleotide
  Description of Combined DNA/RNA Molecule: Synthetic oligonucleotide
tcaaagaactacagttcctgaggaaga

SEQ ID NO: 3356 - DNA, 27 bp, Artificial Sequence
  Description of Artificial Sequence: Synthetic oligonucleotide
  Description of Combined DNA/RNA Molecule: Synthetic oligonucleotide
ctgaggaagaactaaatccaaagatac

SEQ ID NO: 3357 - DNA, 27 bp, Artificial Sequence
  Description of Artificial Sequence: Synthetic oligonucleotide
  Description of Combined DNA/RNA Molecule: Synthetic oligonucleotide
tgaggaagaactaaatccaaagatact

SEQ ID NO: 3358 - DNA, 27 bp, Artificial Sequence
  Description of Artificial Sequence: Synthetic oligonucleotide
  Description of Combined DNA/RNA Molecule: Synthetic oligonucleotide
gaggaagaactaaatccaaagatacta

SEQ ID NO: 3359 - DNA, 27 bp, Artificial Sequence
  Description of Artificial Sequence: Synthetic oligonucleotide
  Description of Combined DNA/RNA Molecule: Synthetic oligonucleotide
aggaagaactaaatccaaagatactag

SEQ ID NO: 3360 - DNA, 27 bp, Artificial Sequence
  Description of Artificial Sequence: Synthetic oligonucleotide
  Description of Combined DNA/RNA Molecule: Synthetic oligonucleotide
ctaaatccaaagatactagctttgcag

SEQ ID NO: 3361 - DNA, 27 bp, Artificial Sequence
  Description of Artificial Sequence: Synthetic oligonucleotide
  Description of Combined DNA/RNA Molecule: Synthetic oligonucleotide
tccaaagatactagctttgcagaatgc

SEQ ID NO: 3362 - DNA, 27 bp, Artificial Sequence
  Description of Artificial Sequence: Synthetic oligonucleotide
  Description of Combined DNA/RNA Molecule: Synthetic oligonucleotide
caaagatactagctttgcagaatgctc

SEQ ID NO: 3363 - DNA, 27 bp, Artificial Sequence
  Description of Artificial Sequence: Synthetic oligonucleotide
  Description of Combined DNA/RNA Molecule: Synthetic oligonucleotide
aaagatactagctttgcagaatgctca

SEQ ID NO: 3364 - DNA, 27 bp, Artificial Sequence
  Description of Artificial Sequence: Synthetic oligonucleotide
  Description of Combined DNA/RNA Molecule: Synthetic oligonucleotide
gagaaagcgaaaaatggaacatgatgg

SEQ ID NO: 3365 - DNA, 27 bp, Artificial Sequence
  Description of Artificial Sequence: Synthetic oligonucleotide
  Description of Combined DNA/RNA Molecule: Synthetic oligonucleotide
aatggaacatgatggttcactttttca

SEQ ID NO: 3366 - DNA, 27 bp, Artificial Sequence
  Description of Artificial Sequence: Synthetic oligonucleotide
  Description of Combined DNA/RNA Molecule: Synthetic oligonucleotide
acatgatggttcactttttcaagcagt

SEQ ID NO: 3367 - DNA, 27 bp, Artificial Sequence
  Description of Artificial Sequence: Synthetic oligonucleotide
  Description of Combined DNA/RNA Molecule: Synthetic oligonucleotide
actttttcaagcagtaggaattggaac

SEQ ID NO: 3368 - DNA, 27 bp, Artificial Sequence
  Description of Artificial Sequence: Synthetic oligonucleotide
  Description of Combined DNA/RNA Molecule: Synthetic oligonucleotide
agcagtaggaattggaacattattaca

SEQ ID NO: 3369 - DNA, 27 bp, Artificial Sequence
  Description of Artificial Sequence: Synthetic oligonucleotide
  Description of Combined DNA/RNA Molecule: Synthetic oligonucleotide
gcagtaggaattggaacattattacag

SEQ ID NO: 3370 - DNA, 27 bp, Artificial Sequence
  Description of Artificial Sequence: Synthetic oligonucleotide
  Description of Combined DNA/RNA Molecule: Synthetic oligonucleotide
cagtaggaattggaacattattacagc

SEQ ID NO: 3371 - DNA, 27 bp, Artificial Sequence
  Description of Artificial Sequence: Synthetic oligonucleotide
  Description of Combined DNA/RNA Molecule: Synthetic oligonucleotide
ttcttggaaacgtgtaaaaggatgcaa

SEQ ID NO: 3372 - DNA, 27 bp, Artificial Sequence
  Description of Artificial Sequence: Synthetic oligonucleotide
  Description of Combined DNA/RNA Molecule: Synthetic oligonucleotide
tcttggaaacgtgtaaaaggatgcaaa

SEQ ID NO: 3373 - DNA, 27 bp, Artificial Sequence
  Description of Artificial Sequence: Synthetic oligonucleotide
  Description of Combined DNA/RNA Molecule: Synthetic oligonucleotide
tgtaaaaggatgcaaatctagtgaaca

SEQ ID NO: 3374 - DNA, 27 bp, Artificial Sequence
  Description of Artificial Sequence: Synthetic oligonucleotide
  Description of Combined DNA/RNA Molecule: Synthetic oligonucleotide
gtaaaaggatgcaaatctagtgaacag

SEQ ID NO: 3375 - DNA, 27 bp, Artificial Sequence
  Description of Artificial Sequence: Synthetic oligonucleotide
  Description of Combined DNA/RNA Molecule: Synthetic oligonucleotide
aggatgcaaatctagtgaacagaatgg

SEQ ID NO: 3376 - DNA, 27 bp, Artificial Sequence
  Description of Artificial Sequence: Synthetic oligonucleotide
  Description of Combined DNA/RNA Molecule: Synthetic oligonucleotide
tgcaaatctagtgaacagaatggaatg

SEQ ID NO: 3377 - DNA, 27 bp, Artificial Sequence
  Description of Artificial Sequence: Synthetic oligonucleotide
  Description of Combined DNA/RNA Molecule: Synthetic oligonucleotide
tctagtgaacagaatggaatggagcaa

SEQ ID NO: 3378 - DNA, 27 bp, Artificial Sequence
  Description of Artificial Sequence: Synthetic oligonucleotide
  Description of Combined DNA/RNA Molecule: Synthetic oligonucleotide
ctagtgaacagaatggaatggagcaaa

SEQ ID NO: 3379 - DNA, 27 bp, Artificial Sequence
  Description of Artificial Sequence: Synthetic oligonucleotide
  Description of Combined DNA/RNA Molecule: Synthetic oligonucleotide
acagaatggaatggagcaaaagacaat

SEQ ID NO: 3380 - DNA, 27 bp, Artificial Sequence
  Description of Artificial Sequence: Synthetic oligonucleotide
  Description of Combined DNA/RNA Molecule: Synthetic oligonucleotide
atggaatggagcaaaagacaattattt

SEQ ID NO: 3381 - DNA, 27 bp, Artificial Sequence
  Description of Artificial Sequence: Synthetic oligonucleotide
  Description of Combined DNA/RNA Molecule: Synthetic oligonucleotide
ggaatggagcaaaagacaattatttta

SEQ ID NO: 3382 - DNA, 27 bp, Artificial Sequence
  Description of Artificial Sequence: Synthetic oligonucleotide
  Description of Combined DNA/RNA Molecule: Synthetic oligonucleotide
gaatggagcaaaagacaattattttaa

SEQ ID NO: 3383 - DNA, 27 bp, Artificial Sequence
  Description of Artificial Sequence: Synthetic oligonucleotide
  Description of Combined DNA/RNA Molecule: Synthetic oligonucleotide
aatggagcaaaagacaattattttaat

SEQ ID NO: 3384 - DNA, 27 bp, Artificial Sequence
  Description of Artificial Sequence: Synthetic oligonucleotide
  Description of Combined DNA/RNA Molecule: Synthetic oligonucleotide
atggagcaaaagacaattattttaata

SEQ ID NO: 3385 - DNA, 27 bp, Artificial Sequence
  Description of Artificial Sequence: Synthetic oligonucleotide
  Description of Combined DNA/RNA Molecule: Synthetic oligonucleotide
acaattattttaataccctctgattta

SEQ ID NO: 3386 - DNA, 27 bp, Artificial Sequence
  Description of Artificial Sequence: Synthetic oligonucleotide
  Description of Combined DNA/RNA Molecule: Synthetic oligonucleotide
caattattttaataccctctgatttag

SEQ ID NO: 3387 - DNA, 27 bp, Artificial Sequence
  Description of Artificial Sequence: Synthetic oligonucleotide
  Description of Combined DNA/RNA Molecule: Synthetic oligonucleotide
aattattttaataccctctgatttagc

SEQ ID NO: 3388 - DNA, 27 bp, Artificial Sequence
  Description of Artificial Sequence: Synthetic oligonucleotide
  Description of Combined DNA/RNA Molecule: Synthetic oligonucleotide
ttattttaataccctctgatttagcat

SEQ ID NO: 3389 - DNA, 27 bp, Artificial Sequence
  Description of Artificial Sequence: Synthetic oligonucleotide
  Description of Combined DNA/RNA Molecule: Synthetic oligonucleotide
tattttaataccctctgatttagcatg

SEQ ID NO: 3390 - DNA, 27 bp, Artificial Sequence
  Description of Artificial Sequence: Synthetic oligonucleotide
  Description of Combined DNA/RNA Molecule: Synthetic oligonucleotide
gctggggcaatcaatggatgaaagtgg

SEQ ID NO: 3391 - DNA, 27 bp, Artificial Sequence
  Description of Artificial Sequence: Synthetic oligonucleotide
  Description of Combined DNA/RNA Molecule: Synthetic oligonucleotide
ggcaatcaatggatgaaagtggattac

SEQ ID NO: 3392 - DNA, 27 bp, Artificial Sequence
  Description of Artificial Sequence: Synthetic oligonucleotide
  Description of Combined DNA/RNA Molecule: Synthetic oligonucleotide
ccagttatgattgtgaagttaatgctc

SEQ ID NO: 3393 - DNA, 27 bp, Artificial Sequence
  Description of Artificial Sequence: Synthetic oligonucleotide
  Description of Combined DNA/RNA Molecule: Synthetic oligonucleotide
cagttatgattgtgaagttaatgctcc

SEQ ID NO: 3394 - DNA, 27 bp, Artificial Sequence
  Description of Artificial Sequence: Synthetic oligonucleotide
  Description of Combined DNA/RNA Molecule: Synthetic oligonucleotide
attgtgaagttaatgctcctatacaag

SEQ ID NO: 3395 - DNA, 27 bp, Artificial Sequence
  Description of Artificial Sequence: Synthetic oligonucleotide
  Description of Combined DNA/RNA Molecule: Synthetic oligonucleotide
tgaagttaatgctcctatacaaggcag

SEQ ID NO: 3396 - DNA, 27 bp, Artificial Sequence
  Description of Artificial Sequence: Synthetic oligonucleotide
  Description of Combined DNA/RNA Molecule: Synthetic oligonucleotide
gcagggtgaagaattactcagagcttt

SEQ ID NO: 3397 - DNA, 27 bp, Artificial Sequence
  Description of Artificial Sequence: Synthetic oligonucleotide
  Description of Combined DNA/RNA Molecule: Synthetic oligonucleotide
tgaagaattactcagagctttggatca

SEQ ID NO: 3398 - DNA, 27 bp, Artificial Sequence
  Description of Artificial Sequence: Synthetic oligonucleotide
  Description of Combined DNA/RNA Molecule: Synthetic oligonucleotide
aagaattactcagagctttggatcaag

SEQ ID NO: 3399 - DNA, 27 bp, Artificial Sequence
  Description of Artificial Sequence: Synthetic oligonucleotide
  Description of Combined DNA/RNA Molecule: Synthetic oligonucleotide
ctcagagctttggatcaagttaactga

SEQ ID NO: 3400 - DNA, 27 bp, Artificial Sequence
  Description of Artificial Sequence: Synthetic oligonucleotide
  Description of Combined DNA/RNA Molecule: Synthetic oligonucleotide
caagttaactgagctttttcttaattt

SEQ ID NO: 3401 - DNA, 27 bp, Artificial Sequence
  Description of Artificial Sequence: Synthetic oligonucleotide
  Description of Combined DNA/RNA Molecule: Synthetic oligonucleotide
agttaactgagctttttcttaatttca

SEQ ID NO: 3402 - DNA, 27 bp, Artificial Sequence
  Description of Artificial Sequence: Synthetic oligonucleotide
  Description of Combined DNA/RNA Molecule: Synthetic oligonucleotide
ctttttcttaatttcattccttttttt

SEQ ID NO: 3403 - DNA, 27 bp, Artificial Sequence
  Description of Artificial Sequence: Synthetic oligonucleotide
  Description of Combined DNA/RNA Molecule: Synthetic oligonucleotide
tcttaatttcattcctttttttggaca

SEQ ID NO: 3404 - DNA, 27 bp, Artificial Sequence
  Description of Artificial Sequence: Synthetic oligonucleotide
  Description of Combined DNA/RNA Molecule: Synthetic oligonucleotide
ttaatttcattcctttttttggacact

SEQ ID NO: 3405 - DNA, 27 bp, Artificial Sequence
  Description of Artificial Sequence: Synthetic oligonucleotide
  Description of Combined DNA/RNA Molecule: Synthetic oligonucleotide
cactggtggctcattacctaaagcagt

SEQ ID NO: 3406 - DNA, 27 bp, Artificial Sequence
  Description of Artificial Sequence: Synthetic oligonucleotide
  Description of Combined DNA/RNA Molecule: Synthetic oligonucleotide
ctcattacctaaagcagtctatttata

SEQ ID NO: 3407 - DNA, 27 bp, Artificial Sequence
  Description of Artificial Sequence: Synthetic oligonucleotide
  Description of Combined DNA/RNA Molecule: Synthetic oligonucleotide
tcattacctaaagcagtctatttatat

SEQ ID NO: 3408 - DNA, 27 bp, Artificial Sequence
  Description of Artificial Sequence: Synthetic oligonucleotide
  Description of Combined DNA/RNA Molecule: Synthetic oligonucleotide
acctaaagcagtctatttatattttct

SEQ ID NO: 3409 - DNA, 27 bp, Artificial Sequence
  Description of Artificial Sequence: Synthetic oligonucleotide
  Description of Combined DNA/RNA Molecule: Synthetic oligonucleotide
ctaaagcagtctatttatattttctac

SEQ ID NO: 3410 - DNA, 27 bp, Artificial Sequence
  Description of Artificial Sequence: Synthetic oligonucleotide
  Description of Combined DNA/RNA Molecule: Synthetic oligonucleotide
tatttatattttctacatctaatttta

SEQ ID NO: 3411 - DNA, 27 bp, Artificial Sequence
  Description of Artificial Sequence: Synthetic oligonucleotide
  Description of Combined DNA/RNA Molecule: Synthetic oligonucleotide
atttatattttctacatctaattttag

SEQ ID NO: 3412 - DNA, 27 bp, Artificial Sequence
  Description of Artificial Sequence: Synthetic oligonucleotide
  Description of Combined DNA/RNA Molecule: Synthetic oligonucleotide
tttatattttctacatctaattttaga

SEQ ID NO: 3413 - DNA, 27 bp, Artificial Sequence
  Description of Artificial Sequence: Synthetic oligonucleotide
  Description of Combined DNA/RNA Molecule: Synthetic oligonucleotide
tatattttctacatctaattttagaag

SEQ ID NO: 3414 - DNA, 27 bp, Artificial Sequence
  Description of Artificial Sequence: Synthetic oligonucleotide
  Description of Combined DNA/RNA Molecule: Synthetic oligonucleotide
atattttctacatctaattttagaagc

SEQ ID NO: 3415 - DNA, 27 bp, Artificial Sequence
  Description of Artificial Sequence: Synthetic oligonucleotide
  Description of Combined DNA/RNA Molecule: Synthetic oligonucleotide
gcctggctacaatactgcacaaacttg

SEQ ID NO: 3416 - DNA, 27 bp, Artificial Sequence
  Description of Artificial Sequence: Synthetic oligonucleotide
  Description of Combined DNA/RNA Molecule: Synthetic oligonucleotide
aacttggttagttcaattttgatcccc

SEQ ID NO: 3417 - DNA, 27 bp, Artificial Sequence
  Description of Artificial Sequence: Synthetic oligonucleotide
  Description of Combined DNA/RNA Molecule: Synthetic oligonucleotide
ttagttcaattttgatcccctttctac

SEQ ID NO: 3418 - DNA, 27 bp, Artificial Sequence
  Description of Artificial Sequence: Synthetic oligonucleotide
  Description of Combined DNA/RNA Molecule: Synthetic oligonucleotide
attttgatcccctttctacttaattta

SEQ ID NO: 3419 - DNA, 27 bp, Artificial Sequence
  Description of Artificial Sequence: Synthetic oligonucleotide
  Description of Combined DNA/RNA Molecule: Synthetic oligonucleotide
ttttgatcccctttctacttaatttac

SEQ ID NO: 3420 - DNA, 27 bp, Artificial Sequence
  Description of Artificial Sequence: Synthetic oligonucleotide
  Description of Combined DNA/RNA Molecule: Synthetic oligonucleotide
tttgatcccctttctacttaatttaca

SEQ ID NO: 3421 - DNA, 27 bp, Artificial Sequence
  Description of Artificial Sequence: Synthetic oligonucleotide
  Description of Combined DNA/RNA Molecule: Synthetic oligonucleotide
ccctttctacttaatttacattaatgc

SEQ ID NO: 3422 - DNA, 27 bp, Artificial Sequence
  Description of Artificial Sequence: Synthetic oligonucleotide
  Description of Combined DNA/RNA Molecule: Synthetic oligonucleotide
ttaatttacattaatgctcttttttag

SEQ ID NO: 3423 - DNA, 27 bp, Artificial Sequence
  Description of Artificial Sequence: Synthetic oligonucleotide
  Description of Combined DNA/RNA Molecule: Synthetic oligonucleotide
taatttacattaatgctcttttttagt

SEQ ID NO: 3424 - DNA, 27 bp, Artificial Sequence
  Description of Artificial Sequence: Synthetic oligonucleotide
  Description of Combined DNA/RNA Molecule: Synthetic oligonucleotide
acattaatgctcttttttagtatgttc

SEQ ID NO: 3425 - DNA, 27 bp, Artificial Sequence
  Description of Artificial Sequence: Synthetic oligonucleotide
  Description of Combined DNA/RNA Molecule: Synthetic oligonucleotide
cattaatgctcttttttagtatgttct

SEQ ID NO: 3426 - DNA, 27 bp, Artificial Sequence
  Description of Artificial Sequence: Synthetic oligonucleotide
  Description of Combined DNA/RNA Molecule: Synthetic oligonucleotide
ttaatgctcttttttagtatgttcttt

SEQ ID NO: 3427 - DNA, 27 bp, Artificial Sequence
  Description of Artificial Sequence: Synthetic oligonucleotide
  Description of Combined DNA/RNA Molecule: Synthetic oligonucleotide
cttttttagtatgttctttaatgctgg

SEQ ID NO: 3428 - DNA, 27 bp, Artificial Sequence
  Description of Artificial Sequence: Synthetic oligonucleotide
  Description of Combined DNA/RNA Molecule: Synthetic oligonucleotide
tttagtatgttctttaatgctggatca

SEQ ID NO: 3429 - DNA, 27 bp, Artificial Sequence
  Description of Artificial Sequence: Synthetic oligonucleotide
  Description of Combined DNA/RNA Molecule: Synthetic oligonucleotide
ttagtatgttctttaatgctggatcac

SEQ ID NO: 3430 - DNA, 27 bp, Artificial Sequence
  Description of Artificial Sequence: Synthetic oligonucleotide
  Description of Combined DNA/RNA Molecule: Synthetic oligonucleotide
tagtatgttctttaatgctggatcaca

SEQ ID NO: 3431 - DNA, 27 bp, Artificial Sequence
  Description of Artificial Sequence: Synthetic oligonucleotide
  Description of Combined DNA/RNA Molecule: Synthetic oligonucleotide
cacagacagctcattttctcagttttt

SEQ ID NO: 3432 - DNA, 27 bp, Artificial Sequence
  Description of Artificial Sequence: Synthetic oligonucleotide
  Description of Combined DNA/RNA Molecule: Synthetic oligonucleotide
ctcattttctcagttttttggtattta

SEQ ID NO: 3433 - DNA, 27 bp, Artificial Sequence
  Description of Artificial Sequence: Synthetic oligonucleotide
  Description of Combined DNA/RNA Molecule: Synthetic oligonucleotide
tcattttctcagttttttggtatttaa

SEQ ID NO: 3434 - DNA, 27 bp, Artificial Sequence
  Description of Artificial Sequence: Synthetic oligonucleotide
  Description of Combined DNA/RNA Molecule: Synthetic oligonucleotide
cattttctcagttttttggtatttaaa

SEQ ID NO: 3435 - DNA, 27 bp, Artificial Sequence
  Description of Artificial Sequence: Synthetic oligonucleotide
  Description of Combined DNA/RNA Molecule: Synthetic oligonucleotide
gttttttggtatttaaaccattgcatt

SEQ ID NO: 3436 - DNA, 27 bp, Artificial Sequence
  Description of Artificial Sequence: Synthetic oligonucleotide
  Description of Combined DNA/RNA Molecule: Synthetic oligonucleotide
tttggtatttaaaccattgcattgcag

SEQ ID NO: 3437 - DNA, 27 bp, Artificial Sequence
  Description of Artificial Sequence: Synthetic oligonucleotide
  Description of Combined DNA/RNA Molecule: Synthetic oligonucleotide
ttggtatttaaaccattgcattgcagt

SEQ ID NO: 3438 - DNA, 27 bp, Artificial Sequence
  Description of Artificial Sequence: Synthetic oligonucleotide
  Description of Combined DNA/RNA Molecule: Synthetic oligonucleotide
atttaaaccattgcattgcagtagcat

SEQ ID NO: 3439 - DNA, 27 bp, Artificial Sequence
  Description of Artificial Sequence: Synthetic oligonucleotide
  Description of Combined DNA/RNA Molecule: Synthetic oligonucleotide
gcattgcagtagcatcattttaaaaaa

SEQ ID NO: 3440 - DNA, 27 bp, Artificial Sequence
  Description of Artificial Sequence: Synthetic oligonucleotide
  Description of Combined DNA/RNA Molecule: Synthetic oligonucleotide
gcagtagcatcattttaaaaaatgcac

SEQ ID NO: 3441 - DNA, 27 bp, Artificial Sequence
  Description of Artificial Sequence: Synthetic oligonucleotide
  Description of Combined DNA/RNA Molecule: Synthetic oligonucleotide
cagtagcatcattttaaaaaatgcacc

SEQ ID NO: 3442 - DNA, 27 bp, Artificial Sequence
  Description of Artificial Sequence: Synthetic oligonucleotide
  Description of Combined DNA/RNA Molecule: Synthetic oligonucleotide
atcattttaaaaaatgcacctttttat

SEQ ID NO: 3443 - DNA, 27 bp, Artificial Sequence
  Description of Artificial Sequence: Synthetic oligonucleotide
  Description of Combined DNA/RNA Molecule: Synthetic oligonucleotide
tcattttaaaaaatgcacctttttatt

SEQ ID NO: 3444 - DNA, 27 bp, Artificial Sequence
  Description of Artificial Sequence: Synthetic oligonucleotide
  Description of Combined DNA/RNA Molecule: Synthetic oligonucleotide
cattttaaaaaatgcacctttttattt

SEQ ID NO: 3445 - DNA, 27 bp, Artificial Sequence
  Description of Artificial Sequence: Synthetic oligonucleotide
  Description of Combined DNA/RNA Molecule: Synthetic oligonucleotide
attttaaaaaatgcacctttttattta

SEQ ID NO: 3446 - DNA, 27 bp, Artificial Sequence
  Description of Artificial Sequence: Synthetic oligonucleotide
  Description of Combined DNA/RNA Molecule: Synthetic oligonucleotide
ttttaaaaaatgcacctttttatttat

SEQ ID NO: 3447 - DNA, 27 bp, Artificial Sequence
  Description of Artificial Sequence: Synthetic oligonucleotide
  Description of Combined DNA/RNA Molecule: Synthetic oligonucleotide
tttaaaaaatgcacctttttatttatt

SEQ ID NO: 3448 - DNA, 27 bp, Artificial Sequence
  Description of Artificial Sequence: Synthetic oligonucleotide
  Description of Combined DNA/RNA Molecule: Synthetic oligonucleotide
taaaaaatgcacctttttatttattta

SEQ ID NO: 3449 - DNA, 27 bp, Artificial Sequence
  Description of Artificial Sequence: Synthetic oligonucleotide
  Description of Combined DNA/RNA Molecule: Synthetic oligonucleotide
aaaaatgcacctttttatttatttatt

SEQ ID NO: 3450 - DNA, 27 bp, Artificial Sequence
  Description of Artificial Sequence: Synthetic oligonucleotide
  Description of Combined DNA/RNA Molecule: Synthetic oligonucleotide
acctttttatttatttatttttggcta

SEQ ID NO: 3451 - DNA, 27 bp, Artificial Sequence
  Description of Artificial Sequence: Synthetic oligonucleotide
  Description of Combined DNA/RNA Molecule: Synthetic oligonucleotide
ttatttatttatttttggctagggagt

SEQ ID NO: 3452 - DNA, 27 bp, Artificial Sequence
  Description of Artificial Sequence: Synthetic oligonucleotide
  Description of Combined DNA/RNA Molecule: Synthetic oligonucleotide
atttatttatttttggctagggagttt

SEQ ID NO: 3453 - DNA, 27 bp, Artificial Sequence
  Description of Artificial Sequence: Synthetic oligonucleotide
  Description of Combined DNA/RNA Molecule: Synthetic oligonucleotide
tttatttatttttggctagggagttta

SEQ ID NO: 3454 - DNA, 27 bp, Artificial Sequence
  Description of Artificial Sequence: Synthetic oligonucleotide
  Description of Combined DNA/RNA Molecule: Synthetic oligonucleotide
ttatttatttttggctagggagtttat

SEQ ID NO: 3455 - DNA, 27 bp, Artificial Sequence
  Description of Artificial Sequence: Synthetic oligonucleotide
  Description of Combined DNA/RNA Molecule: Synthetic oligonucleotide
tatttatttttggctagggagtttatc

SEQ ID NO: 3456 - DNA, 27 bp, Artificial Sequence
  Description of Artificial Sequence: Synthetic oligonucleotide
  Description of Combined DNA/RNA Molecule: Synthetic oligonucleotide
agggagtttatccctttttcgaattat

SEQ ID NO: 3457 - DNA, 27 bp, Artificial Sequence
  Description of Artificial Sequence: Synthetic oligonucleotide
  Description of Combined DNA/RNA Molecule: Synthetic oligonucleotide
gggagtttatccctttttcgaattatt

SEQ ID NO: 3458 - DNA, 27 bp, Artificial Sequence
  Description of Artificial Sequence: Synthetic oligonucleotide
  Description of Combined DNA/RNA Molecule: Synthetic oligonucleotide
ggagtttatccctttttcgaattattt

SEQ ID NO: 3459 - DNA, 27 bp, Artificial Sequence
  Description of Artificial Sequence: Synthetic oligonucleotide
  Description of Combined DNA/RNA Molecule: Synthetic oligonucleotide
gagtttatccctttttcgaattatttt

SEQ ID NO: 3460 - DNA, 27 bp, Artificial Sequence
  Description of Artificial Sequence: Synthetic oligonucleotide
  Description of Combined DNA/RNA Molecule: Synthetic oligonucleotide
agtttatccctttttcgaattattttt

SEQ ID NO: 3461 - DNA, 27 bp, Artificial Sequence
  Description of Artificial Sequence: Synthetic oligonucleotide
  Description of Combined DNA/RNA Molecule: Synthetic oligonucleotide
gtttatccctttttcgaattattttta

SEQ ID NO: 3462 - DNA, 27 bp, Artificial Sequence
  Description of Artificial Sequence: Synthetic oligonucleotide
  Description of Combined DNA/RNA Molecule: Synthetic oligonucleotide
ttcgaattatttttaagaagatgccaa

SEQ ID NO: 3463 - DNA, 27 bp, Artificial Sequence
  Description of Artificial Sequence: Synthetic oligonucleotide
  Description of Combined DNA/RNA Molecule: Synthetic oligonucleotide
attatttttaagaagatgccaatataa

SEQ ID NO: 3464 - DNA, 27 bp, Artificial Sequence
  Description of Artificial Sequence: Synthetic oligonucleotide
  Description of Combined DNA/RNA Molecule: Synthetic oligonucleotide
ttatttttaagaagatgccaatataat

SEQ ID NO: 3465 - DNA, 27 bp, Artificial Sequence
  Description of Artificial Sequence: Synthetic oligonucleotide
  Description of Combined DNA/RNA Molecule: Synthetic oligonucleotide
atttttaagaagatgccaatataattt

SEQ ID NO: 3466 - DNA, 27 bp, Artificial Sequence
  Description of Artificial Sequence: Synthetic oligonucleotide
  Description of Combined DNA/RNA Molecule: Synthetic oligonucleotide
tttttaagaagatgccaatataatttt

SEQ ID NO: 3467 - DNA, 27 bp, Artificial Sequence
  Description of Artificial Sequence: Synthetic oligonucleotide
  Description of Combined DNA/RNA Molecule: Synthetic oligonucleotide
tttaagaagatgccaatataatttttg

SEQ ID NO: 3468 - DNA, 27 bp, Artificial Sequence
  Description of Artificial Sequence: Synthetic oligonucleotide
  Description of Combined DNA/RNA Molecule: Synthetic oligonucleotide
ttaagaagatgccaatataatttttgt

SEQ ID NO: 3469 - DNA, 27 bp, Artificial Sequence
  Description of Artificial Sequence: Synthetic oligonucleotide
  Description of Combined DNA/RNA Molecule: Synthetic oligonucleotide
aagaagatgccaatataatttttgtaa

SEQ ID NO: 3470 - DNA, 27 bp, Artificial Sequence
  Description of Artificial Sequence: Synthetic oligonucleotide
  Description of Combined DNA/RNA Molecule: Synthetic oligonucleotide
agaagatgccaatataatttttgtaag

SEQ ID NO: 3471 - DNA, 27 bp, Artificial Sequence
  Description of Artificial Sequence: Synthetic oligonucleotide
  Description of Combined DNA/RNA Molecule: Synthetic oligonucleotide
gaagatgccaatataatttttgtaaga

SEQ ID NO: 3472 - DNA, 27 bp, Artificial Sequence
  Description of Artificial Sequence: Synthetic oligonucleotide
  Description of Combined DNA/RNA Molecule: Synthetic oligonucleotide
ccaatataatttttgtaagaaggcagt

SEQ ID NO: 3473 - DNA, 27 bp, Artificial Sequence
  Description of Artificial Sequence: Synthetic oligonucleotide
  Description of Combined DNA/RNA Molecule: Synthetic oligonucleotide
tataatttttgtaagaaggcagtaacc

SEQ ID NO: 3474 - DNA, 27 bp, Artificial Sequence
  Description of Artificial Sequence: Synthetic oligonucleotide
  Description of Combined DNA/RNA Molecule: Synthetic oligonucleotide
taatttttgtaagaaggcagtaacctt

SEQ ID NO: 3475 - DNA, 27 bp, Artificial Sequence
  Description of Artificial Sequence: Synthetic oligonucleotide
  Description of Combined DNA/RNA Molecule: Synthetic oligonucleotide
atcatgatcataggcagttgaaaaatt

SEQ ID NO: 3476 - DNA, 27 bp, Artificial Sequence
  Description of Artificial Sequence: Synthetic oligonucleotide
  Description of Combined DNA/RNA Molecule: Synthetic oligonucleotide
catgatcataggcagttgaaaaatttt

SEQ ID NO: 3477 - DNA, 27 bp, Artificial Sequence
  Description of Artificial Sequence: Synthetic oligonucleotide
  Description of Combined DNA/RNA Molecule: Synthetic oligonucleotide
atcataggcagttgaaaaatttttaca

SEQ ID NO: 3478 - DNA, 27 bp, Artificial Sequence
  Description of Artificial Sequence: Synthetic oligonucleotide
  Description of Combined DNA/RNA Molecule: Synthetic oligonucleotide
cataggcagttgaaaaatttttacacc

SEQ ID NO: 3479 - DNA, 27 bp, Artificial Sequence
  Description of Artificial Sequence: Synthetic oligonucleotide
  Description of Combined DNA/RNA Molecule: Synthetic oligonucleotide
gttgaaaaatttttacacctttttttt

SEQ ID NO: 3480 - DNA, 27 bp, Artificial Sequence
  Description of Artificial Sequence: Synthetic oligonucleotide
  Description of Combined DNA/RNA Molecule: Synthetic oligonucleotide
ttgaaaaatttttacaccttttttttc

SEQ ID NO: 3481 - DNA, 27 bp, Artificial Sequence
  Description of Artificial Sequence: Synthetic oligonucleotide
  Description of Combined DNA/RNA Molecule: Synthetic oligonucleotide
tgaaaaatttttacaccttttttttca

SEQ ID NO: 3482 - DNA, 27 bp, Artificial Sequence
  Description of Artificial Sequence: Synthetic oligonucleotide
  Description of Combined DNA/RNA Molecule: Synthetic oligonucleotide
gaaaaatttttacaccttttttttcac

SEQ ID NO: 3483 - DNA, 27 bp, Artificial Sequence
  Description of Artificial Sequence: Synthetic oligonucleotide
  Description of Combined DNA/RNA Molecule: Synthetic oligonucleotide
aaaaatttttacaccttttttttcaca

SEQ ID NO: 3484 - DNA, 27 bp, Artificial Sequence
  Description of Artificial Sequence: Synthetic oligonucleotide
  Description of Combined DNA/RNA Molecule: Synthetic oligonucleotide
cttttttttcacattttacataaataa

SEQ ID NO: 3485 - DNA, 27 bp, Artificial Sequence
  Description of Artificial Sequence: Synthetic oligonucleotide
  Description of Combined DNA/RNA Molecule: Synthetic oligonucleotide
ttttttttcacattttacataaataat

SEQ ID NO: 3486 - DNA, 27 bp, Artificial Sequence
  Description of Artificial Sequence: Synthetic oligonucleotide
  Description of Combined DNA/RNA Molecule: Synthetic oligonucleotide
tttttttcacattttacataaataata

SEQ ID NO: 3487 - DNA, 27 bp, Artificial Sequence
  Description of Artificial Sequence: Synthetic oligonucleotide
  Description of Combined DNA/RNA Molecule: Synthetic oligonucleotide
ttttttcacattttacataaataataa

SEQ ID NO: 3488 - DNA, 27 bp, Artificial Sequence
  Description of Artificial Sequence: Synthetic oligonucleotide
  Description of Combined DNA/RNA Molecule: Synthetic oligonucleotide
cacattttacataaataataatgcttt

SEQ ID NO: 3489 - DNA, 27 bp, Artificial Sequence
  Description of Artificial Sequence: Synthetic oligonucleotide
  Description of Combined DNA/RNA Molecule: Synthetic oligonucleotide
tggtagccacaattgcacaatatattt

SEQ ID NO: 3490 - DNA, 27 bp, Artificial Sequence
  Description of Artificial Sequence: Synthetic oligonucleotide
  Description of Combined DNA/RNA Molecule: Synthetic oligonucleotide
acaatatattttcttaaaaaataccag

SEQ ID NO: 3491 - DNA, 27 bp, Artificial Sequence
  Description of Artificial Sequence: Synthetic oligonucleotide
  Description of Combined DNA/RNA Molecule: Synthetic oligonucleotide
ttcttaaaaaataccagcagttactca

SEQ ID NO: 3492 - DNA, 27 bp, Artificial Sequence
  Description of Artificial Sequence: Synthetic oligonucleotide
  Description of Combined DNA/RNA Molecule: Synthetic oligonucleotide
agcagttactcatggaatatattctgc

SEQ ID NO: 3493 - DNA, 27 bp, Artificial Sequence
  Description of Artificial Sequence: Synthetic oligonucleotide
  Description of Combined DNA/RNA Molecule: Synthetic oligonucleotide
ctcatggaatatattctgcgtttataa

SEQ ID NO: 3494 - DNA, 27 bp, Artificial Sequence
  Description of Artificial Sequence: Synthetic oligonucleotide
  Description of Combined DNA/RNA Molecule: Synthetic oligonucleotide
tcatggaatatattctgcgtttataaa

SEQ ID NO: 3495 - DNA, 27 bp, Artificial Sequence
  Description of Artificial Sequence: Synthetic oligonucleotide
  Description of Combined DNA/RNA Molecule: Synthetic oligonucleotide
catggaatatattctgcgtttataaaa

SEQ ID NO: 3496 - DNA, 27 bp, Artificial Sequence
  Description of Artificial Sequence: Synthetic oligonucleotide
  Description of Combined DNA/RNA Molecule: Synthetic oligonucleotide
atggaatatattctgcgtttataaaac

SEQ ID NO: 3497 - DNA, 27 bp, Artificial Sequence
  Description of Artificial Sequence: Synthetic oligonucleotide
  Description of Combined DNA/RNA Molecule: Synthetic oligonucleotide
tggaatatattctgcgtttataaaact

SEQ ID NO: 3498 - DNA, 27 bp, Artificial Sequence
  Description of Artificial Sequence: Synthetic oligonucleotide
  Description of Combined DNA/RNA Molecule: Synthetic oligonucleotide
ggaatatattctgcgtttataaaacta

SEQ ID NO: 3499 - DNA, 27 bp, Artificial Sequence
  Description of Artificial Sequence: Synthetic oligonucleotide
  Description of Combined DNA/RNA Molecule: Synthetic oligonucleotide
gaatatattctgcgtttataaaactag

SEQ ID NO: 3500 - DNA, 27 bp, Artificial Sequence
  Description of Artificial Sequence: Synthetic oligonucleotide
  Description of Combined DNA/RNA Molecule: Synthetic oligonucleotide
ttataaaactagtttttaagaagaaat

SEQ ID NO: 3501 - DNA, 27 bp, Artificial Sequence
  Description of Artificial Sequence: Synthetic oligonucleotide
  Description of Combined DNA/RNA Molecule: Synthetic oligonucleotide
aactagtttttaagaagaaattttttt

SEQ ID NO: 3502 - DNA, 27 bp, Artificial Sequence
  Description of Artificial Sequence: Synthetic oligonucleotide
  Description of Combined DNA/RNA Molecule: Synthetic oligonucleotide
actagtttttaagaagaaatttttttt

SEQ ID NO: 3503 - DNA, 27 bp, Artificial Sequence
  Description of Artificial Sequence: Synthetic oligonucleotide
  Description of Combined DNA/RNA Molecule: Synthetic oligonucleotide
ctagtttttaagaagaaattttttttg

SEQ ID NO: 3504 - DNA, 27 bp, Artificial Sequence
  Description of Artificial Sequence: Synthetic oligonucleotide
  Description of Combined DNA/RNA Molecule: Synthetic oligonucleotide
tagtttttaagaagaaattttttttgg

SEQ ID NO: 3505 - DNA, 27 bp, Artificial Sequence
  Description of Artificial Sequence: Synthetic oligonucleotide
  Description of Combined DNA/RNA Molecule: Synthetic oligonucleotide
tttttaagaagaaattttttttggcct

SEQ ID NO: 3506 - DNA, 27 bp, Artificial Sequence
  Description of Artificial Sequence: Synthetic oligonucleotide
  Description of Combined DNA/RNA Molecule: Synthetic oligonucleotide
agaagaaattttttttggcctatgaaa

SEQ ID NO: 3507 - DNA, 27 bp, Artificial Sequence
  Description of Artificial Sequence: Synthetic oligonucleotide
  Description of Combined DNA/RNA Molecule: Synthetic oligonucleotide
aagaaattttttttggcctatgaaatt

SEQ ID NO: 3508 - DNA, 27 bp, Artificial Sequence
  Description of Artificial Sequence: Synthetic oligonucleotide
  Description of Combined DNA/RNA Molecule: Synthetic oligonucleotide
gaaattttttttggcctatgaaattgt

SEQ ID NO: 3509 - DNA, 27 bp, Artificial Sequence
  Description of Artificial Sequence: Synthetic oligonucleotide
  Description of Combined DNA/RNA Molecule: Synthetic oligonucleotide
aattttttttggcctatgaaattgtta

SEQ ID NO: 3510 - DNA, 27 bp, Artificial Sequence
  Description of Artificial Sequence: Synthetic oligonucleotide
  Description of Combined DNA/RNA Molecule: Synthetic oligonucleotide
tttttttggcctatgaaattgttaaac

SEQ ID NO: 3511 - DNA, 27 bp, Artificial Sequence
  Description of Artificial Sequence: Synthetic oligonucleotide
  Description of Combined DNA/RNA Molecule: Synthetic oligonucleotide
ttttttggcctatgaaattgttaaacc

SEQ ID NO: 3512 - DNA, 27 bp, Artificial Sequence
  Description of Artificial Sequence: Synthetic oligonucleotide
  Description of Combined DNA/RNA Molecule: Synthetic oligonucleotide
tttttggcctatgaaattgttaaacct

SEQ ID NO: 3513 - DNA, 27 bp, Artificial Sequence
  Description of Artificial Sequence: Synthetic oligonucleotide
  Description of Combined DNA/RNA Molecule: Synthetic oligonucleotide
ttttggcctatgaaattgttaaacctg

SEQ ID NO: 3514 - DNA, 27 bp, Artificial Sequence
  Description of Artificial Sequence: Synthetic oligonucleotide
  Description of Combined DNA/RNA Molecule: Synthetic oligonucleotide
gcctatgaaattgttaaacctggaaca

SEQ ID NO: 3515 - DNA, 27 bp, Artificial Sequence
  Description of Artificial Sequence: Synthetic oligonucleotide
  Description of Combined DNA/RNA Molecule: Synthetic oligonucleotide
ctatgaaattgttaaacctggaacatg

SEQ ID NO: 3516 - DNA, 27 bp, Artificial Sequence
  Description of Artificial Sequence: Synthetic oligonucleotide
  Description of Combined DNA/RNA Molecule: Synthetic oligonucleotide
gaaattgttaaacctggaacatgacat

SEQ ID NO: 3517 - DNA, 27 bp, Artificial Sequence
  Description of Artificial Sequence: Synthetic oligonucleotide
  Description of Combined DNA/RNA Molecule: Synthetic oligonucleotide
aaattgttaaacctggaacatgacatt

SEQ ID NO: 3518 - DNA, 27 bp, Artificial Sequence
  Description of Artificial Sequence: Synthetic oligonucleotide
  Description of Combined DNA/RNA Molecule: Synthetic oligonucleotide
acctggaacatgacattgttaatcata

SEQ ID NO: 3519 - DNA, 27 bp, Artificial Sequence
  Description of Artificial Sequence: Synthetic oligonucleotide
  Description of Combined DNA/RNA Molecule: Synthetic oligonucleotide
aacatgacattgttaatcatataataa

SEQ ID NO: 3520 - DNA, 27 bp, Artificial Sequence
  Description of Artificial Sequence: Synthetic oligonucleotide
  Description of Combined DNA/RNA Molecule: Synthetic oligonucleotide
acatgacattgttaatcatataataat

SEQ ID NO: 3521 - DNA, 27 bp, Artificial Sequence
  Description of Artificial Sequence: Synthetic oligonucleotide
  Description of Combined DNA/RNA Molecule: Synthetic oligonucleotide
gacattgttaatcatataataatgatt

SEQ ID NO: 3522 - DNA, 27 bp, Artificial Sequence
  Description of Artificial Sequence: Synthetic oligonucleotide
  Description of Combined DNA/RNA Molecule: Synthetic oligonucleotide
cattgttaatcatataataatgattct

SEQ ID NO: 3523 - DNA, 27 bp, Artificial Sequence
  Description of Artificial Sequence: Synthetic oligonucleotide
  Description of Combined DNA/RNA Molecule: Synthetic oligonucleotide
attgttaatcatataataatgattctt

SEQ ID NO: 3524 - DNA, 27 bp, Artificial Sequence
  Description of Artificial Sequence: Synthetic oligonucleotide
  Description of Combined DNA/RNA Molecule: Synthetic oligonucleotide
ttgttaatcatataataatgattctta

SEQ ID NO: 3525 - DNA, 27 bp, Artificial Sequence
  Description of Artificial Sequence: Synthetic oligonucleotide
  Description of Combined DNA/RNA Molecule: Synthetic oligonucleotide
tcatataataatgattcttaaatgctg

SEQ ID NO: 3526 - DNA, 27 bp, Artificial Sequence
  Description of Artificial Sequence: Synthetic oligonucleotide
  Description of Combined DNA/RNA Molecule: Synthetic oligonucleotide
catataataatgattcttaaatgctgt

SEQ ID NO: 3527 - DNA, 27 bp, Artificial Sequence
  Description of Artificial Sequence: Synthetic oligonucleotide
  Description of Combined DNA/RNA Molecule: Synthetic oligonucleotide
taataatgattcttaaatgctgtatgg

SEQ ID NO: 3528 - DNA, 27 bp, Artificial Sequence
  Description of Artificial Sequence: Synthetic oligonucleotide
  Description of Combined DNA/RNA Molecule: Synthetic oligonucleotide
taatgattcttaaatgctgtatggttt

SEQ ID NO: 3529 - DNA, 27 bp, Artificial Sequence
  Description of Artificial Sequence: Synthetic oligonucleotide
  Description of Combined DNA/RNA Molecule: Synthetic oligonucleotide
aatgattcttaaatgctgtatggttta

SEQ ID NO: 3530 - DNA, 27 bp, Artificial Sequence
  Description of Artificial Sequence: Synthetic oligonucleotide
  Description of Combined DNA/RNA Molecule: Synthetic oligonucleotide
atgattcttaaatgctgtatggtttat

SEQ ID NO: 3531 - DNA, 27 bp, Artificial Sequence
  Description of Artificial Sequence: Synthetic oligonucleotide
  Description of Combined DNA/RNA Molecule: Synthetic oligonucleotide
tcttaaatgctgtatggtttattattt

SEQ ID NO: 3532 - DNA, 27 bp, Artificial Sequence
  Description of Artificial Sequence: Synthetic oligonucleotide
  Description of Combined DNA/RNA Molecule: Synthetic oligonucleotide
cttaaatgctgtatggtttattattta

SEQ ID NO: 3533 - DNA, 27 bp, Artificial Sequence
  Description of Artificial Sequence: Synthetic oligonucleotide
  Description of Combined DNA/RNA Molecule: Synthetic oligonucleotide
taaatgctgtatggtttattatttaaa

SEQ ID NO: 3534 - DNA, 27 bp, Artificial Sequence
  Description of Artificial Sequence: Synthetic oligonucleotide
  Description of Combined DNA/RNA Molecule: Synthetic oligonucleotide
tgtatggtttattatttaaatgggtaa

SEQ ID NO: 3535 - DNA, 27 bp, Artificial Sequence
  Description of Artificial Sequence: Synthetic oligonucleotide
  Description of Combined DNA/RNA Molecule: Synthetic oligonucleotide
tatggtttattatttaaatgggtaaag

SEQ ID NO: 3536 - DNA, 27 bp, Artificial Sequence
  Description of Artificial Sequence: Synthetic oligonucleotide
  Description of Combined DNA/RNA Molecule: Synthetic oligonucleotide
atggtttattatttaaatgggtaaagc

SEQ ID NO: 3537 - DNA, 27 bp, Artificial Sequence
  Description of Artificial Sequence: Synthetic oligonucleotide
  Description of Combined DNA/RNA Molecule: Synthetic oligonucleotide
ggtttattatttaaatgggtaaagcca

SEQ ID NO: 3538 - DNA, 27 bp, Artificial Sequence
  Description of Artificial Sequence: Synthetic oligonucleotide
  Description of Combined DNA/RNA Molecule: Synthetic oligonucleotide
gtttattatttaaatgggtaaagccat

SEQ ID NO: 3539 - DNA, 27 bp, Artificial Sequence
  Description of Artificial Sequence: Synthetic oligonucleotide
  Description of Combined DNA/RNA Molecule: Synthetic oligonucleotide
ttatttaaatgggtaaagccatttaca

SEQ ID NO: 3540 - DNA, 27 bp, Artificial Sequence
  Description of Artificial Sequence: Synthetic oligonucleotide
  Description of Combined DNA/RNA Molecule: Synthetic oligonucleotide
aaatgggtaaagccatttacataatat

SEQ ID NO: 3541 - DNA, 27 bp, Artificial Sequence
  Description of Artificial Sequence: Synthetic oligonucleotide
  Description of Combined DNA/RNA Molecule: Synthetic oligonucleotide
tgggtaaagccatttacataatataga

SEQ ID NO: 3542 - DNA, 27 bp, Artificial Sequence
  Description of Artificial Sequence: Synthetic oligonucleotide
  Description of Combined DNA/RNA Molecule: Synthetic oligonucleotide
ggtaaagccatttacataatatagaaa

SEQ ID NO: 3543 - DNA, 27 bp, Artificial Sequence
  Description of Artificial Sequence: Synthetic oligonucleotide
  Description of Combined DNA/RNA Molecule: Synthetic oligonucleotide
gtaaagccatttacataatatagaaag

SEQ ID NO: 3544 - DNA, 27 bp, Artificial Sequence
  Description of Artificial Sequence: Synthetic oligonucleotide
  Description of Combined DNA/RNA Molecule: Synthetic oligonucleotide
gccatttacataatatagaaagatatg

SEQ ID NO: 3545 - DNA, 27 bp, Artificial Sequence
  Description of Artificial Sequence: Synthetic oligonucleotide
  Description of Combined DNA/RNA Molecule: Synthetic oligonucleotide
ataatatagaaagatatgcatatatct

SEQ ID NO: 3546 - DNA, 27 bp, Artificial Sequence
  Description of Artificial Sequence: Synthetic oligonucleotide
  Description of Combined DNA/RNA Molecule: Synthetic oligonucleotide
taatatagaaagatatgcatatatcta

SEQ ID NO: 3547 - DNA, 27 bp, Artificial Sequence
  Description of Artificial Sequence: Synthetic oligonucleotide
  Description of Combined DNA/RNA Molecule: Synthetic oligonucleotide
aatatagaaagatatgcatatatctag

SEQ ID NO: 3548 - DNA, 27 bp, Artificial Sequence
  Description of Artificial Sequence: Synthetic oligonucleotide
  Description of Combined DNA/RNA Molecule: Synthetic oligonucleotide
tagaaagatatgcatatatctagaagg

SEQ ID NO: 3549 - DNA, 27 bp, Artificial Sequence
  Description of Artificial Sequence: Synthetic oligonucleotide
  Description of Combined DNA/RNA Molecule: Synthetic oligonucleotide
aaagatatgcatatatctagaaggtat

SEQ ID NO: 3550 - DNA, 27 bp, Artificial Sequence
  Description of Artificial Sequence: Synthetic oligonucleotide
  Description of Combined DNA/RNA Molecule: Synthetic oligonucleotide
aagatatgcatatatctagaaggtatg

SEQ ID NO: 3551 - DNA, 27 bp, Artificial Sequence
  Description of Artificial Sequence: Synthetic oligonucleotide
  Description of Combined DNA/RNA Molecule: Synthetic oligonucleotide
agatatgcatatatctagaaggtatgt

SEQ ID NO: 3552 - DNA, 27 bp, Artificial Sequence
  Description of Artificial Sequence: Synthetic oligonucleotide
  Description of Combined DNA/RNA Molecule: Synthetic oligonucleotide
tgcatatatctagaaggtatgtggcat

SEQ ID NO: 3553 - DNA, 27 bp, Artificial Sequence
  Description of Artificial Sequence: Synthetic oligonucleotide
  Description of Combined DNA/RNA Molecule: Synthetic oligonucleotide
gcatatatctagaaggtatgtggcatt

SEQ ID NO: 3554 - DNA, 27 bp, Artificial Sequence
  Description of Artificial Sequence: Synthetic oligonucleotide
  Description of Combined DNA/RNA Molecule: Synthetic oligonucleotide
tctagaaggtatgtggcatttatttgg

SEQ ID NO: 3555 - DNA, 27 bp, Artificial Sequence
  Description of Artificial Sequence: Synthetic oligonucleotide
  Description of Combined DNA/RNA Molecule: Synthetic oligonucleotide
gaaggtatgtggcatttatttggataa

SEQ ID NO: 3556 - DNA, 27 bp, Artificial Sequence
  Description of Artificial Sequence: Synthetic oligonucleotide
  Description of Combined DNA/RNA Molecule: Synthetic oligonucleotide
gtatgtggcatttatttggataaaatt

SEQ ID NO: 3557 - DNA, 27 bp, Artificial Sequence
  Description of Artificial Sequence: Synthetic oligonucleotide
  Description of Combined DNA/RNA Molecule: Synthetic oligonucleotide
atgtggcatttatttggataaaattct

SEQ ID NO: 3558 - DNA, 27 bp, Artificial Sequence
  Description of Artificial Sequence: Synthetic oligonucleotide
  Description of Combined DNA/RNA Molecule: Synthetic oligonucleotide
tttatttggataaaattctcaattcag

SEQ ID NO: 3559 - DNA, 27 bp, Artificial Sequence
  Description of Artificial Sequence: Synthetic oligonucleotide
  Description of Combined DNA/RNA Molecule: Synthetic oligonucleotide
tggataaaattctcaattcagagaaat

SEQ ID NO: 3560 - DNA, 27 bp, Artificial Sequence
  Description of Artificial Sequence: Synthetic oligonucleotide
  Description of Combined DNA/RNA Molecule: Synthetic oligonucleotide
gataaaattctcaattcagagaaatca

SEQ ID NO: 3561 - DNA, 27 bp, Artificial Sequence
  Description of Artificial Sequence: Synthetic oligonucleotide
  Description of Combined DNA/RNA Molecule: Synthetic oligonucleotide
taaaattctcaattcagagaaatcatc

SEQ ID NO: 3562 - DNA, 27 bp, Artificial Sequence
  Description of Artificial Sequence: Synthetic oligonucleotide
  Description of Combined DNA/RNA Molecule: Synthetic oligonucleotide
tcaattcagagaaatcatctgatgttt

SEQ ID NO: 3563 - DNA, 27 bp, Artificial Sequence
  Description of Artificial Sequence: Synthetic oligonucleotide
  Description of Combined DNA/RNA Molecule: Synthetic oligonucleotide
ttcagagaaatcatctgatgtttctat

SEQ ID NO: 3564 - DNA, 27 bp, Artificial Sequence
  Description of Artificial Sequence: Synthetic oligonucleotide
  Description of Combined DNA/RNA Molecule: Synthetic oligonucleotide
agaaatcatctgatgtttctatagtca

SEQ ID NO: 3565 - DNA, 27 bp, Artificial Sequence
  Description of Artificial Sequence: Synthetic oligonucleotide
  Description of Combined DNA/RNA Molecule: Synthetic oligonucleotide
tctgatgtttctatagtcactttgcca

SEQ ID NO: 3566 - DNA, 27 bp, Artificial Sequence
  Description of Artificial Sequence: Synthetic oligonucleotide
  Description of Combined DNA/RNA Molecule: Synthetic oligonucleotide
ctgatgtttctatagtcactttgccag

SEQ ID NO: 3567 - DNA, 27 bp, Artificial Sequence
  Description of Artificial Sequence: Synthetic oligonucleotide
  Description of Combined DNA/RNA Molecule: Synthetic oligonucleotide
tcaaaagaaaacaataccctatgtagt

SEQ ID NO: 3568 - DNA, 27 bp, Artificial Sequence
  Description of Artificial Sequence: Synthetic oligonucleotide
  Description of Combined DNA/RNA Molecule: Synthetic oligonucleotide
aaaagaaaacaataccctatgtagttg

SEQ ID NO: 3569 - DNA, 27 bp, Artificial Sequence
  Description of Artificial Sequence: Synthetic oligonucleotide
  Description of Combined DNA/RNA Molecule: Synthetic oligonucleotide
aaagaaaacaataccctatgtagttgt

SEQ ID NO: 3570 - DNA, 27 bp, Artificial Sequence
  Description of Artificial Sequence: Synthetic oligonucleotide
  Description of Combined DNA/RNA Molecule: Synthetic oligonucleotide
agaaaacaataccctatgtagttgtgg

SEQ ID NO: 3571 - DNA, 27 bp, Artificial Sequence
  Description of Artificial Sequence: Synthetic oligonucleotide
  Description of Combined DNA/RNA Molecule: Synthetic oligonucleotide
aacaataccctatgtagttgtggaagt

SEQ ID NO: 3572 - DNA, 27 bp, Artificial Sequence
  Description of Artificial Sequence: Synthetic oligonucleotide
  Description of Combined DNA/RNA Molecule: Synthetic oligonucleotide
cctatgtagttgtggaagtttatgcta

SEQ ID NO: 3573 - DNA, 27 bp, Artificial Sequence
  Description of Artificial Sequence: Synthetic oligonucleotide
  Description of Combined DNA/RNA Molecule: Synthetic oligonucleotide
ctatgtagttgtggaagtttatgctaa

SEQ ID NO: 3574 - DNA, 27 bp, Artificial Sequence
  Description of Artificial Sequence: Synthetic oligonucleotide
  Description of Combined DNA/RNA Molecule: Synthetic oligonucleotide
tagttgtggaagtttatgctaatattg

SEQ ID NO: 3575 - DNA, 27 bp, Artificial Sequence
  Description of Artificial Sequence: Synthetic oligonucleotide
  Description of Combined DNA/RNA Molecule: Synthetic oligonucleotide
agttgtggaagtttatgctaatattgt

SEQ ID NO: 3576 - DNA, 27 bp, Artificial Sequence
  Description of Artificial Sequence: Synthetic oligonucleotide
  Description of Combined DNA/RNA Molecule: Synthetic oligonucleotide
ttgtggaagtttatgctaatattgtgt

SEQ ID NO: 3577 - DNA, 27 bp, Artificial Sequence
  Description of Artificial Sequence: Synthetic oligonucleotide
  Description of Combined DNA/RNA Molecule: Synthetic oligonucleotide
gtggaagtttatgctaatattgtgtaa

SEQ ID NO: 3578 - DNA, 27 bp, Artificial Sequence
  Description of Artificial Sequence: Synthetic oligonucleotide
  Description of Combined DNA/RNA Molecule: Synthetic oligonucleotide
tggaagtttatgctaatattgtgtaac

SEQ ID NO: 3579 - DNA, 27 bp, Artificial Sequence
  Description of Artificial Sequence: Synthetic oligonucleotide
  Description of Combined DNA/RNA Molecule: Synthetic oligonucleotide
ggaagtttatgctaatattgtgtaact

SEQ ID NO: 3580 - DNA, 27 bp, Artificial Sequence
  Description of Artificial Sequence: Synthetic oligonucleotide
  Description of Combined DNA/RNA Molecule: Synthetic oligonucleotide
aagtttatgctaatattgtgtaactga

SEQ ID NO: 3581 - DNA, 27 bp, Artificial Sequence
  Description of Artificial Sequence: Synthetic oligonucleotide
  Description of Combined DNA/RNA Molecule: Synthetic oligonucleotide
tgctaatattgtgtaactgatattaaa

SEQ ID NO: 3582 - DNA, 27 bp, Artificial Sequence
  Description of Artificial Sequence: Synthetic oligonucleotide
  Description of Combined DNA/RNA Molecule: Synthetic oligonucleotide
ctaatattgtgtaactgatattaaacc

SEQ ID NO: 3583 - DNA, 27 bp, Artificial Sequence
  Description of Artificial Sequence: Synthetic oligonucleotide
  Description of Combined DNA/RNA Molecule: Synthetic oligonucleotide
aatattgtgtaactgatattaaaccta

SEQ ID NO: 3584 - DNA, 27 bp, Artificial Sequence
  Description of Artificial Sequence: Synthetic oligonucleotide
  Description of Combined DNA/RNA Molecule: Synthetic oligonucleotide
aactgatattaaacctaaatgttctgc

SEQ ID NO: 3585 - DNA, 27 bp, Artificial Sequence
  Description of Artificial Sequence: Synthetic oligonucleotide
  Description of Combined DNA/RNA Molecule: Synthetic oligonucleotide
ctgttggtataaagatattttgagcag

SEQ ID NO: 3586 - DNA, 27 bp, Artificial Sequence
  Description of Artificial Sequence: Synthetic oligonucleotide
  Description of Combined DNA/RNA Molecule: Synthetic oligonucleotide
ggtataaagatattttgagcagactgt

SEQ ID NO: 3587 - DNA, 27 bp, Artificial Sequence
  Description of Artificial Sequence: Synthetic oligonucleotide
  Description of Combined DNA/RNA Molecule: Synthetic oligonucleotide
taaagatattttgagcagactgtaaac

SEQ ID NO: 3588 - DNA, 27 bp, Artificial Sequence
  Description of Artificial Sequence: Synthetic oligonucleotide
  Description of Combined DNA/RNA Molecule: Synthetic oligonucleotide
aaagatattttgagcagactgtaaaca

SEQ ID NO: 3589 - DNA, 27 bp, Artificial Sequence
  Description of Artificial Sequence: Synthetic oligonucleotide
  Description of Combined DNA/RNA Molecule: Synthetic oligonucleotide
aagatattttgagcagactgtaaacaa

SEQ ID NO: 3590 - DNA, 27 bp, Artificial Sequence
  Description of Artificial Sequence: Synthetic oligonucleotide
  Description of Combined DNA/RNA Molecule: Synthetic oligonucleotide
attttgagcagactgtaaacaagaaaa

SEQ ID NO: 3591 - DNA, 27 bp, Artificial Sequence
  Description of Artificial Sequence: Synthetic oligonucleotide
  Description of Combined DNA/RNA Molecule: Synthetic oligonucleotide
tttgagcagactgtaaacaagaaaaaa

SEQ ID NO: 3592 - DNA, 27 bp, Artificial Sequence
  Description of Artificial Sequence: Synthetic oligonucleotide
  Description of Combined DNA/RNA Molecule: Synthetic oligonucleotide
agcagactgtaaacaagaaaaaaaaaa

SEQ ID NO: 3593 - DNA, 27 bp, Artificial Sequence
  Description of Artificial Sequence: Synthetic oligonucleotide
  Description of Combined DNA/RNA Molecule: Synthetic oligonucleotide
gactgtaaacaagaaaaaaaaaatcat

SEQ ID NO: 3594 - DNA, 27 bp, Artificial Sequence
  Description of Artificial Sequence: Synthetic oligonucleotide
  Description of Combined DNA/RNA Molecule: Synthetic oligonucleotide
actgtaaacaagaaaaaaaaaatcatg

SEQ ID NO: 3595 - DNA, 27 bp, Artificial Sequence
  Description of Artificial Sequence: Synthetic oligonucleotide
  Description of Combined DNA/RNA Molecule: Synthetic oligonucleotide
aaaaaaaaaatcatgcattcttagcaa

SEQ ID NO: 3596 - DNA, 27 bp, Artificial Sequence
  Description of Artificial Sequence: Synthetic oligonucleotide
  Description of Combined DNA/RNA Molecule: Synthetic oligonucleotide
aaaaaaaaatcatgcattcttagcaaa

SEQ ID NO: 3597 - DNA, 27 bp, Artificial Sequence
  Description of Artificial Sequence: Synthetic oligonucleotide
  Description of Combined DNA/RNA Molecule: Synthetic oligonucleotide
atcatgcattcttagcaaaattgccta

SEQ ID NO: 3598 - DNA, 27 bp, Artificial Sequence
  Description of Artificial Sequence: Synthetic oligonucleotide
  Description of Combined DNA/RNA Molecule: Synthetic oligonucleotide
ttcttagcaaaattgcctagtatgtta

SEQ ID NO: 3599 - DNA, 27 bp, Artificial Sequence
  Description of Artificial Sequence: Synthetic oligonucleotide
  Description of Combined DNA/RNA Molecule: Synthetic oligonucleotide
tcttagcaaaattgcctagtatgttaa

SEQ ID NO: 3600 - DNA, 27 bp, Artificial Sequence
  Description of Artificial Sequence: Synthetic oligonucleotide
  Description of Combined DNA/RNA Molecule: Synthetic oligonucleotide
gcaaaattgcctagtatgttaatttgc

SEQ ID NO: 3601 - DNA, 27 bp, Artificial Sequence
  Description of Artificial Sequence: Synthetic oligonucleotide
  Description of Combined DNA/RNA Molecule: Synthetic oligonucleotide
aaaattgcctagtatgttaatttgctc

SEQ ID NO: 3602 - DNA, 27 bp, Artificial Sequence
  Description of Artificial Sequence: Synthetic oligonucleotide
  Description of Combined DNA/RNA Molecule: Synthetic oligonucleotide
aaattgcctagtatgttaatttgctca

SEQ ID NO: 3603 - DNA, 27 bp, Artificial Sequence
  Description of Artificial Sequence: Synthetic oligonucleotide
  Description of Combined DNA/RNA Molecule: Synthetic oligonucleotide
cctagtatgttaatttgctcaaaatac

SEQ ID NO: 3604 - DNA, 27 bp, Artificial Sequence
  Description of Artificial Sequence: Synthetic oligonucleotide
  Description of Combined DNA/RNA Molecule: Synthetic oligonucleotide
ctagtatgttaatttgctcaaaataca

SEQ ID NO: 3605 - DNA, 27 bp, Artificial Sequence
  Description of Artificial Sequence: Synthetic oligonucleotide
  Description of Combined DNA/RNA Molecule: Synthetic oligonucleotide
tagtatgttaatttgctcaaaatacaa

SEQ ID NO: 3606 - DNA, 27 bp, Artificial Sequence
  Description of Artificial Sequence: Synthetic oligonucleotide
  Description of Combined DNA/RNA Molecule: Synthetic oligonucleotide
gttaatttgctcaaaatacaatgtttg

SEQ ID NO: 3607 - DNA, 27 bp, Artificial Sequence
  Description of Artificial Sequence: Synthetic oligonucleotide
  Description of Combined DNA/RNA Molecule: Synthetic oligonucleotide
ttaatttgctcaaaatacaatgtttga

SEQ ID NO: 3608 - DNA, 27 bp, Artificial Sequence
  Description of Artificial Sequence: Synthetic oligonucleotide
  Description of Combined DNA/RNA Molecule: Synthetic oligonucleotide
aatttgctcaaaatacaatgtttgatt

SEQ ID NO: 3609 - DNA, 27 bp, Artificial Sequence
  Description of Artificial Sequence: Synthetic oligonucleotide
  Description of Combined DNA/RNA Molecule: Synthetic oligonucleotide
ctcaaaatacaatgtttgattttatgc

SEQ ID NO: 3610 - DNA, 27 bp, Artificial Sequence
  Description of Artificial Sequence: Synthetic oligonucleotide
  Description of Combined DNA/RNA Molecule: Synthetic oligonucleotide
caaaatacaatgtttgattttatgcac

SEQ ID NO: 3611 - DNA, 27 bp, Artificial Sequence
  Description of Artificial Sequence: Synthetic oligonucleotide
  Description of Combined DNA/RNA Molecule: Synthetic oligonucleotide
aaaatacaatgtttgattttatgcact

SEQ ID NO: 3612 - DNA, 27 bp, Artificial Sequence
  Description of Artificial Sequence: Synthetic oligonucleotide
  Description of Combined DNA/RNA Molecule: Synthetic oligonucleotide
caatgtttgattttatgcactttgtcg

SEQ ID NO: 3613 - DNA, 27 bp, Artificial Sequence
  Description of Artificial Sequence: Synthetic oligonucleotide
  Description of Combined DNA/RNA Molecule: Synthetic oligonucleotide
aatgtttgattttatgcactttgtcgc

SEQ ID NO: 3614 - DNA, 27 bp, Artificial Sequence
  Description of Artificial Sequence: Synthetic oligonucleotide
  Description of Combined DNA/RNA Molecule: Synthetic oligonucleotide
tttatgcactttgtcgctattaacatc

SEQ ID NO: 3615 - DNA, 27 bp, Artificial Sequence
  Description of Artificial Sequence: Synthetic oligonucleotide
  Description of Combined DNA/RNA Molecule: Synthetic oligonucleotide
ctttgtcgctattaacatccttttttt

SEQ ID NO: 3616 - DNA, 27 bp, Artificial Sequence
  Description of Artificial Sequence: Synthetic oligonucleotide
  Description of Combined DNA/RNA Molecule: Synthetic oligonucleotide
ctttttttcatgtagatttcaataatt

SEQ ID NO: 3617 - DNA, 27 bp, Artificial Sequence
  Description of Artificial Sequence: Synthetic oligonucleotide
  Description of Combined DNA/RNA Molecule: Synthetic oligonucleotide
tttttttcatgtagatttcaataattg

SEQ ID NO: 3618 - DNA, 27 bp, Artificial Sequence
  Description of Artificial Sequence: Synthetic oligonucleotide
  Description of Combined DNA/RNA Molecule: Synthetic oligonucleotide
ttcatgtagatttcaataattgagtaa

SEQ ID NO: 3619 - DNA, 27 bp, Artificial Sequence
  Description of Artificial Sequence: Synthetic oligonucleotide
  Description of Combined DNA/RNA Molecule: Synthetic oligonucleotide
tcatgtagatttcaataattgagtaat

SEQ ID NO: 3620 - DNA, 27 bp, Artificial Sequence
  Description of Artificial Sequence: Synthetic oligonucleotide
  Description of Combined DNA/RNA Molecule: Synthetic oligonucleotide
catgtagatttcaataattgagtaatt

SEQ ID NO: 3621 - DNA, 27 bp, Artificial Sequence
  Description of Artificial Sequence: Synthetic oligonucleotide
  Description of Combined DNA/RNA Molecule: Synthetic oligonucleotide
atgtagatttcaataattgagtaattt

SEQ ID NO: 3622 - DNA, 27 bp, Artificial Sequence
  Description of Artificial Sequence: Synthetic oligonucleotide
  Description of Combined DNA/RNA Molecule: Synthetic oligonucleotide
tgtagatttcaataattgagtaatttt

SEQ ID NO: 3623 - DNA, 27 bp, Artificial Sequence
  Description of Artificial Sequence: Synthetic oligonucleotide
  Description of Combined DNA/RNA Molecule: Synthetic oligonucleotide
gtagatttcaataattgagtaatttta

SEQ ID NO: 3624 - DNA, 27 bp, Artificial Sequence
  Description of Artificial Sequence: Synthetic oligonucleotide
  Description of Combined DNA/RNA Molecule: Synthetic oligonucleotide
tagatttcaataattgagtaattttag

SEQ ID NO: 3625 - DNA, 27 bp, Artificial Sequence
  Description of Artificial Sequence: Synthetic oligonucleotide
  Description of Combined DNA/RNA Molecule: Synthetic oligonucleotide
agatttcaataattgagtaattttaga

SEQ ID NO: 3626 - DNA, 27 bp, Artificial Sequence
  Description of Artificial Sequence: Synthetic oligonucleotide
  Description of Combined DNA/RNA Molecule: Synthetic oligonucleotide
caataattgagtaattttagaagcatt

SEQ ID NO: 3627 - DNA, 27 bp, Artificial Sequence
  Description of Artificial Sequence: Synthetic oligonucleotide
  Description of Combined DNA/RNA Molecule: Synthetic oligonucleotide
aattgagtaattttagaagcattattt

SEQ ID NO: 3628 - DNA, 27 bp, Artificial Sequence
  Description of Artificial Sequence: Synthetic oligonucleotide
  Description of Combined DNA/RNA Molecule: Synthetic oligonucleotide
attgagtaattttagaagcattatttt

SEQ ID NO: 3629 - DNA, 27 bp, Artificial Sequence
  Description of Artificial Sequence: Synthetic oligonucleotide
  Description of Combined DNA/RNA Molecule: Synthetic oligonucleotide
tgagtaattttagaagcattattttag

SEQ ID NO: 3630 - DNA, 27 bp, Artificial Sequence
  Description of Artificial Sequence: Synthetic oligonucleotide
  Description of Combined DNA/RNA Molecule: Synthetic oligonucleotide
taattttagaagcattattttaggaat

SEQ ID NO: 3631 - DNA, 27 bp, Artificial Sequence
  Description of Artificial Sequence: Synthetic oligonucleotide
  Description of Combined DNA/RNA Molecule: Synthetic oligonucleotide
tttagaagcattattttaggaatatat

SEQ ID NO: 3632 - DNA, 27 bp, Artificial Sequence
  Description of Artificial Sequence: Synthetic oligonucleotide
  Description of Combined DNA/RNA Molecule: Synthetic oligonucleotide
tagaagcattattttaggaatatatag

SEQ ID NO: 3633 - DNA, 27 bp, Artificial Sequence
  Description of Artificial Sequence: Synthetic oligonucleotide
  Description of Combined DNA/RNA Molecule: Synthetic oligonucleotide
agcattattttaggaatatatagttgt

SEQ ID NO: 3634 - DNA, 27 bp, Artificial Sequence
  Description of Artificial Sequence: Synthetic oligonucleotide
  Description of Combined DNA/RNA Molecule: Synthetic oligonucleotide
cattattttaggaatatatagttgtca

SEQ ID NO: 3635 - DNA, 27 bp, Artificial Sequence
  Description of Artificial Sequence: Synthetic oligonucleotide
  Description of Combined DNA/RNA Molecule: Synthetic oligonucleotide
taggaatatatagttgtcacagtaaat

SEQ ID NO: 3636 - DNA, 27 bp, Artificial Sequence
  Description of Artificial Sequence: Synthetic oligonucleotide
  Description of Combined DNA/RNA Molecule: Synthetic oligonucleotide
aggaatatatagttgtcacagtaaata

SEQ ID NO: 3637 - DNA, 27 bp, Artificial Sequence
  Description of Artificial Sequence: Synthetic oligonucleotide
  Description of Combined DNA/RNA Molecule: Synthetic oligonucleotide
ggaatatatagttgtcacagtaaatat

SEQ ID NO: 3638 - DNA, 27 bp, Artificial Sequence
  Description of Artificial Sequence: Synthetic oligonucleotide
  Description of Combined DNA/RNA Molecule: Synthetic oligonucleotide
aatatatagttgtcacagtaaatatct

SEQ ID NO: 3639 - DNA, 27 bp, Artificial Sequence
  Description of Artificial Sequence: Synthetic oligonucleotide
  Description of Combined DNA/RNA Molecule: Synthetic oligonucleotide
atatatagttgtcacagtaaatatctt

SEQ ID NO: 3640 - DNA, 27 bp, Artificial Sequence
  Description of Artificial Sequence: Synthetic oligonucleotide
  Description of Combined DNA/RNA Molecule: Synthetic oligonucleotide
tagttgtcacagtaaatatcttgtttt

SEQ ID NO: 3641 - DNA, 27 bp, Artificial Sequence
  Description of Artificial Sequence: Synthetic oligonucleotide
  Description of Combined DNA/RNA Molecule: Synthetic oligonucleotide
agttgtcacagtaaatatcttgttttt

SEQ ID NO: 3642 - DNA, 27 bp, Artificial Sequence
  Description of Artificial Sequence: Synthetic oligonucleotide
  Description of Combined DNA/RNA Molecule: Synthetic oligonucleotide
gtaaatatcttgttttttctatgtaca

SEQ ID NO: 3643 - DNA, 27 bp, Artificial Sequence
  Description of Artificial Sequence: Synthetic oligonucleotide
  Description of Combined DNA/RNA Molecule: Synthetic oligonucleotide
taaatatcttgttttttctatgtacat

SEQ ID NO: 3644 - DNA, 27 bp, Artificial Sequence
  Description of Artificial Sequence: Synthetic oligonucleotide
  Description of Combined DNA/RNA Molecule: Synthetic oligonucleotide
atcttgttttttctatgtacattgtac

SEQ ID NO: 3645 - DNA, 27 bp, Artificial Sequence
  Description of Artificial Sequence: Synthetic oligonucleotide
  Description of Combined DNA/RNA Molecule: Synthetic oligonucleotide
tcttgttttttctatgtacattgtaca

SEQ ID NO: 3646 - DNA, 27 bp, Artificial Sequence
  Description of Artificial Sequence: Synthetic oligonucleotide
  Description of Combined DNA/RNA Molecule: Synthetic oligonucleotide
cttgttttttctatgtacattgtacaa

SEQ ID NO: 3647 - DNA, 27 bp, Artificial Sequence
  Description of Artificial Sequence: Synthetic oligonucleotide
  Description of Combined DNA/RNA Molecule: Synthetic oligonucleotide
ttgttttttctatgtacattgtacaaa

SEQ ID NO: 3648 - DNA, 27 bp, Artificial Sequence
  Description of Artificial Sequence: Synthetic oligonucleotide
  Description of Combined DNA/RNA Molecule: Synthetic oligonucleotide
ttctatgtacattgtacaaatttttca

SEQ ID NO: 3649 - DNA, 27 bp, Artificial Sequence
  Description of Artificial Sequence: Synthetic oligonucleotide
  Description of Combined DNA/RNA Molecule: Synthetic oligonucleotide
tctatgtacattgtacaaatttttcat

SEQ ID NO: 3650 - DNA, 27 bp, Artificial Sequence
  Description of Artificial Sequence: Synthetic oligonucleotide
  Description of Combined DNA/RNA Molecule: Synthetic oligonucleotide
atttttcattccttttgctctttgtgg

SEQ ID NO: 3651 - DNA, 27 bp, Artificial Sequence
  Description of Artificial Sequence: Synthetic oligonucleotide
  Description of Combined DNA/RNA Molecule: Synthetic oligonucleotide
tggttggatctaacactaactgtattg

SEQ ID NO: 3652 - DNA, 27 bp, Artificial Sequence
  Description of Artificial Sequence: Synthetic oligonucleotide
  Description of Combined DNA/RNA Molecule: Synthetic oligonucleotide
ggttggatctaacactaactgtattgt

SEQ ID NO: 3653 - DNA, 27 bp, Artificial Sequence
  Description of Artificial Sequence: Synthetic oligonucleotide
  Description of Combined DNA/RNA Molecule: Synthetic oligonucleotide
ttggatctaacactaactgtattgttt

SEQ ID NO: 3654 - DNA, 27 bp, Artificial Sequence
  Description of Artificial Sequence: Synthetic oligonucleotide
  Description of Combined DNA/RNA Molecule: Synthetic oligonucleotide
ctgtattgttttgttacatcaaataaa

SEQ ID NO: 3655 - DNA, 27 bp, Artificial Sequence
  Description of Artificial Sequence: Synthetic oligonucleotide
  Description of Combined DNA/RNA Molecule: Synthetic oligonucleotide
tgtattgttttgttacatcaaataaac

SEQ ID NO: 3656 - DNA, 27 bp, Artificial Sequence
  Description of Artificial Sequence: Synthetic oligonucleotide
  Description of Combined DNA/RNA Molecule: Synthetic oligonucleotide
gtattgttttgttacatcaaataaaca

SEQ ID NO: 3657 - DNA, 27 bp, Artificial Sequence
  Description of Artificial Sequence: Synthetic oligonucleotide
  Description of Combined DNA/RNA Molecule: Synthetic oligonucleotide
attgttttgttacatcaaataaacatc

SEQ ID NO: 3658 - DNA, 27 bp, Artificial Sequence
  Description of Artificial Sequence: Synthetic oligonucleotide
  Description of Combined DNA/RNA Molecule: Synthetic oligonucleotide
tctgtggaccaggcaaaaaaaaaaaaa

SEQ ID NO: 3659 - DNA, 27 bp, Artificial Sequence
  Description of Artificial Sequence: Synthetic oligonucleotide
  Description of Combined DNA/RNA Molecule: Synthetic oligonucleotide
ctgtggaccaggcaaaaaaaaaaaaaa

SEQ ID NO: 3660 - DNA, 27 bp, Artificial Sequence
  Description of Artificial Sequence: Synthetic oligonucleotide
  Description of Combined DNA/RNA Molecule: Synthetic oligonucleotide
accaggcaaaaaaaaaaaaaaaaaaaa

SEQ ID NO: 3661 - DNA, 27 bp, Artificial Sequence
  Description of Artificial Sequence: Synthetic oligonucleotide
  Description of Combined DNA/RNA Molecule: Synthetic oligonucleotide
cactttttcaagcagtaggaattattt

SEQ ID NO: 3662 - DNA, 27 bp, Artificial Sequence
  Description of Artificial Sequence: Synthetic oligonucleotide
  Description of Combined DNA/RNA Molecule: Synthetic oligonucleotide
actttttcaagcagtaggaattattta

SEQ ID NO: 3663 - DNA, 27 bp, Artificial Sequence
  Description of Artificial Sequence: Synthetic oligonucleotide
  Description of Combined DNA/RNA Molecule: Synthetic oligonucleotide
ttcaagcagtaggaattatttagcatg

SEQ ID NO: 3664 - DNA, 27 bp, Artificial Sequence
  Description of Artificial Sequence: Synthetic oligonucleotide
  Description of Combined DNA/RNA Molecule: Synthetic oligonucleotide
agcagtaggaattatttagcatgtaga

SEQ ID NO: 3665 - DNA, 27 bp, Artificial Sequence
  Description of Artificial Sequence: Synthetic oligonucleotide
  Description of Combined DNA/RNA Molecule: Synthetic oligonucleotide
cagtaggaattatttagcatgtagact

SEQ ID NO: 3666 - DNA, 27 bp, Artificial Sequence
  Description of Artificial Sequence: Synthetic oligonucleotide
  Description of Combined DNA/RNA Molecule: Synthetic oligonucleotide
agtaggaattatttagcatgtagactg

SEQ ID NO: 3667 - DNA, 27 bp, Artificial Sequence
  Description of Artificial Sequence: Synthetic oligonucleotide
  Description of Combined DNA/RNA Molecule: Synthetic oligonucleotide
gtaggaattatttagcatgtagactgc

SEQ ID NO: 3668 - RNA, 21 nt, Artificial Sequence
  Description of Artificial Sequence: Synthetic oligonucleotide
  Description of Combined DNA/RNA Molecule: Synthetic oligonucleotide
aaagauaaguucugaacgucg

SEQ ID NO: 3669 - RNA, 21 nt, Artificial Sequence
  Description of Artificial Sequence: Synthetic oligonucleotide
  Description of Combined DNA/RNA Molecule: Synthetic oligonucleotide
gauaaguucugaacgucgaaa

SEQ ID NO: 3670 - RNA, 21 nt, Artificial Sequence
  Description of Artificial Sequence: Synthetic oligonucleotide
  Description of Combined DNA/RNA Molecule: Synthetic oligonucleotide
uaaguucugaacgucgaaaag

SEQ ID NO: 3671 - RNA, 21 nt, Artificial Sequence
  Description of Artificial Sequence: Synthetic oligonucleotide
  Description of Combined DNA/RNA Molecule: Synthetic oligonucleotide
uucugaacgucgaaaagaaaa

SEQ ID NO: 3672 - RNA, 21 nt, Artificial Sequence
  Description of Artificial Sequence: Synthetic oligonucleotide
  Description of Combined DNA/RNA Molecule: Synthetic oligonucleotide
gucgaaaagaaaagucucgag

SEQ ID NO: 3673 - RNA, 21 nt, Artificial Sequence
  Description of Artificial Sequence: Synthetic oligonucleotide
  Description of Combined DNA/RNA Molecule: Synthetic oligonucleotide
ucgaaaagaaaagucucgaga

SEQ ID NO: 3674 - RNA, 21 nt, Artificial Sequence
  Description of Artificial Sequence: Synthetic oligonucleotide
  Description of Combined DNA/RNA Molecule: Synthetic oligonucleotide
ggcgaaguaaagaaucugaag

SEQ ID NO: 3675 - RNA, 21 nt, Artificial Sequence
  Description of Artificial Sequence: Synthetic oligonucleotide
  Description of Combined DNA/RNA Molecule: Synthetic oligonucleotide
gcgaaguaaagaaucugaagu

SEQ ID NO: 3676 - RNA, 21 nt, Artificial Sequence
  Description of Artificial Sequence: Synthetic oligonucleotide
  Description of Combined DNA/RNA Molecule: Synthetic oligonucleotide
gaaguaaagaaucugaaguuu

SEQ ID NO: 3677 - RNA, 21 nt, Artificial Sequence
  Description of Artificial Sequence: Synthetic oligonucleotide
  Description of Combined DNA/RNA Molecule: Synthetic oligonucleotide
aaguaaagaaucugaaguuuu

SEQ ID NO: 3678 - RNA, 21 nt, Artificial Sequence
  Description of Artificial Sequence: Synthetic oligonucleotide
  Description of Combined DNA/RNA Molecule: Synthetic oligonucleotide
guaaagaaucugaaguuuuuu

SEQ ID NO: 3679 - RNA, 21 nt, Artificial Sequence
  Description of Artificial Sequence: Synthetic oligonucleotide
  Description of Combined DNA/RNA Molecule: Synthetic oligonucleotide
aucugaaguuuuuuaugagcu

SEQ ID NO: 3680 - RNA, 21 nt, Artificial Sequence
  Description of Artificial Sequence: Synthetic oligonucleotide
  Description of Combined DNA/RNA Molecule: Synthetic oligonucleotide
caguugccacuuccacauaau

SEQ ID NO: 3681 - RNA, 21 nt, Artificial Sequence
  Description of Artificial Sequence: Synthetic oligonucleotide
  Description of Combined DNA/RNA Molecule: Synthetic oligonucleotide
augugaguucgcaucuugaua

SEQ ID NO: 3682 - RNA, 21 nt, Artificial Sequence
  Description of Artificial Sequence: Synthetic oligonucleotide
  Description of Combined DNA/RNA Molecule: Synthetic oligonucleotide
augaggcuuaccaucagcuau

SEQ ID NO: 3683 - RNA, 21 nt, Artificial Sequence
  Description of Artificial Sequence: Synthetic oligonucleotide
  Description of Combined DNA/RNA Molecule: Synthetic oligonucleotide
ugaggaaacuucuggaugcug

SEQ ID NO: 3684 - RNA, 21 nt, Artificial Sequence
  Description of Artificial Sequence: Synthetic oligonucleotide
  Description of Combined DNA/RNA Molecule: Synthetic oligonucleotide
ugcuggugauuuggauauuga

SEQ ID NO: 3685 - RNA, 21 nt, Artificial Sequence
  Description of Artificial Sequence: Synthetic oligonucleotide
  Description of Combined DNA/RNA Molecule: Synthetic oligonucleotide
cuggugauuuggauauugaag

SEQ ID NO: 3686 - RNA, 21 nt, Artificial Sequence
  Description of Artificial Sequence: Synthetic oligonucleotide
  Description of Combined DNA/RNA Molecule: Synthetic oligonucleotide
auuuggauauugaagaugaca

SEQ ID NO: 3687 - RNA, 21 nt, Artificial Sequence
  Description of Artificial Sequence: Synthetic oligonucleotide
  Description of Combined DNA/RNA Molecule: Synthetic oligonucleotide
uuuggauauugaagaugacau

SEQ ID NO: 3688 - RNA, 21 nt, Artificial Sequence
  Description of Artificial Sequence: Synthetic oligonucleotide
  Description of Combined DNA/RNA Molecule: Synthetic oligonucleotide
uggauauugaagaugacauga

SEQ ID NO: 3689 - RNA, 21 nt, Artificial Sequence
  Description of Artificial Sequence: Synthetic oligonucleotide
  Description of Combined DNA/RNA Molecule: Synthetic oligonucleotide
ggauauugaagaugacaugaa

SEQ ID NO: 3690 - RNA, 21 nt, Artificial Sequence
  Description of Artificial Sequence: Synthetic oligonucleotide
  Description of Combined DNA/RNA Molecule: Synthetic oligonucleotide
gaagaugacaugaaagcacag

SEQ ID NO: 3691 - RNA, 21 nt, Artificial Sequence
  Description of Artificial Sequence: Synthetic oligonucleotide
  Description of Combined DNA/RNA Molecule: Synthetic oligonucleotide
aagaugacaugaaagcacaga

SEQ ID NO: 3692 - RNA, 21 nt, Artificial Sequence
  Description of Artificial Sequence: Synthetic oligonucleotide
  Description of Combined DNA/RNA Molecule: Synthetic oligonucleotide
ugaaagcacagaugaauugcu

SEQ ID NO: 3693 - RNA, 21 nt, Artificial Sequence
  Description of Artificial Sequence: Synthetic oligonucleotide
  Description of Combined DNA/RNA Molecule: Synthetic oligonucleotide
cacagaugaauugcuuuuauu

SEQ ID NO: 3694 - RNA, 21 nt, Artificial Sequence
  Description of Artificial Sequence: Synthetic oligonucleotide
  Description of Combined DNA/RNA Molecule: Synthetic oligonucleotide
acagaugaauugcuuuuauuu

SEQ ID NO: 3695 - RNA, 21 nt, Artificial Sequence
  Description of Artificial Sequence: Synthetic oligonucleotide
  Description of Combined DNA/RNA Molecule: Synthetic oligonucleotide
uuuuauuugaaagccuuggau

SEQ ID NO: 3696 - RNA, 21 nt, Artificial Sequence
  Description of Artificial Sequence: Synthetic oligonucleotide
  Description of Combined DNA/RNA Molecule: Synthetic oligonucleotide
uuuauuugaaagccuuggaug

SEQ ID NO: 3697 - RNA, 21 nt, Artificial Sequence
  Description of Artificial Sequence: Synthetic oligonucleotide
  Description of Combined DNA/RNA Molecule: Synthetic oligonucleotide
ugaaagccuuggaugguuuug

SEQ ID NO: 3698 - RNA, 21 nt, Artificial Sequence
  Description of Artificial Sequence: Synthetic oligonucleotide
  Description of Combined DNA/RNA Molecule: Synthetic oligonucleotide
guuuuguuaugguucucacag

SEQ ID NO: 3699 - RNA, 21 nt, Artificial Sequence
  Description of Artificial Sequence: Synthetic oligonucleotide
  Description of Combined DNA/RNA Molecule: Synthetic oligonucleotide
uuaugguucucacagaugaug

SEQ ID NO: 3700 - RNA, 21 nt, Artificial Sequence
  Description of Artificial Sequence: Synthetic oligonucleotide
  Description of Combined DNA/RNA Molecule: Synthetic oligonucleotide
uaugguucucacagaugaugg

SEQ ID NO: 3701 - RNA, 21 nt, Artificial Sequence
  Description of Artificial Sequence: Synthetic oligonucleotide
  Description of Combined DNA/RNA Molecule: Synthetic oligonucleotide
cacagaugauggugacaugau

SEQ ID NO: 3702 - RNA, 21 nt, Artificial Sequence
  Description of Artificial Sequence: Synthetic oligonucleotide
  Description of Combined DNA/RNA Molecule: Synthetic oligonucleotide
augauggugacaugauuuaca

SEQ ID NO: 3703 - RNA, 21 nt, Artificial Sequence
  Description of Artificial Sequence: Synthetic oligonucleotide
  Description of Combined DNA/RNA Molecule: Synthetic oligonucleotide
ugauggugacaugauuuacau

SEQ ID NO: 3704 - RNA, 21 nt, Artificial Sequence
  Description of Artificial Sequence: Synthetic oligonucleotide
  Description of Combined DNA/RNA Molecule: Synthetic oligonucleotide
acaugauuuacauuucugaua

SEQ ID NO: 3705 - RNA, 21 nt, Artificial Sequence
  Description of Artificial Sequence: Synthetic oligonucleotide
  Description of Combined DNA/RNA Molecule: Synthetic oligonucleotide
augauuuacauuucugauaau

SEQ ID NO: 3706 - RNA, 21 nt, Artificial Sequence
  Description of Artificial Sequence: Synthetic oligonucleotide
  Description of Combined DNA/RNA Molecule: Synthetic oligonucleotide
gauuuacauuucugauaaugu

SEQ ID NO: 3707 - RNA, 21 nt, Artificial Sequence
  Description of Artificial Sequence: Synthetic oligonucleotide
  Description of Combined DNA/RNA Molecule: Synthetic oligonucleotide
acauuucugauaaugugaaca

SEQ ID NO: 3708 - RNA, 21 nt, Artificial Sequence
  Description of Artificial Sequence: Synthetic oligonucleotide
  Description of Combined DNA/RNA Molecule: Synthetic oligonucleotide
gauaaugugaacaaauacaug

SEQ ID NO: 3709 - RNA, 21 nt, Artificial Sequence
  Description of Artificial Sequence: Synthetic oligonucleotide
  Description of Combined DNA/RNA Molecule: Synthetic oligonucleotide
auaaugugaacaaauacaugg

SEQ ID NO: 3710 - RNA, 21 nt, Artificial Sequence
  Description of Artificial Sequence: Synthetic oligonucleotide
  Description of Combined DNA/RNA Molecule: Synthetic oligonucleotide
uaaugugaacaaauacauggg

SEQ ID NO: 3711 - RNA, 21 nt, Artificial Sequence
  Description of Artificial Sequence: Synthetic oligonucleotide
  Description of Combined DNA/RNA Molecule: Synthetic oligonucleotide
aaugugaacaaauacauggga

SEQ ID NO: 3712 - RNA, 21 nt, Artificial Sequence
  Description of Artificial Sequence: Synthetic oligonucleotide
  Description of Combined DNA/RNA Molecule: Synthetic oligonucleotide
augugaacaaauacaugggau

SEQ ID NO: 3713 - RNA, 21 nt, Artificial Sequence
  Description of Artificial Sequence: Synthetic oligonucleotide
  Description of Combined DNA/RNA Molecule: Synthetic oligonucleotide
ugugaacaaauacaugggauu

SEQ ID NO: 3714 - RNA, 21 nt, Artificial Sequence
  Description of Artificial Sequence: Synthetic oligonucleotide
  Description of Combined DNA/RNA Molecule: Synthetic oligonucleotide
uacaugggauuaacucaguuu

SEQ ID NO: 3715 - RNA, 21 nt, Artificial Sequence
  Description of Artificial Sequence: Synthetic oligonucleotide
  Description of Combined DNA/RNA Molecule: Synthetic oligonucleotide
acaugggauuaacucaguuug

SEQ ID NO: 3716 - RNA, 21 nt, Artificial Sequence
  Description of Artificial Sequence: Synthetic oligonucleotide
  Description of Combined DNA/RNA Molecule: Synthetic oligonucleotide
aguuugaacuaacuggacaca

SEQ ID NO: 3717 - RNA, 21 nt, Artificial Sequence
  Description of Artificial Sequence: Synthetic oligonucleotide
  Description of Combined DNA/RNA Molecule: Synthetic oligonucleotide
aacuggacacaguguguuuga

SEQ ID NO: 3718 - RNA, 21 nt, Artificial Sequence
  Description of Artificial Sequence: Synthetic oligonucleotide
  Description of Combined DNA/RNA Molecule: Synthetic oligonucleotide
acuggacacaguguguuugau

SEQ ID NO: 3719 - RNA, 21 nt, Artificial Sequence
  Description of Artificial Sequence: Synthetic oligonucleotide
  Description of Combined DNA/RNA Molecule: Synthetic oligonucleotide
uguuugauuuuacucauccau

SEQ ID NO: 3720 - RNA, 21 nt, Artificial Sequence
  Description of Artificial Sequence: Synthetic oligonucleotide
  Description of Combined DNA/RNA Molecule: Synthetic oligonucleotide
uuugauuuuacucauccaugu

SEQ ID NO: 3721 - RNA, 21 nt, Artificial Sequence
  Description of Artificial Sequence: Synthetic oligonucleotide
  Description of Combined DNA/RNA Molecule: Synthetic oligonucleotide
uccaugugaccaugaggaaau

SEQ ID NO: 3722 - RNA, 21 nt, Artificial Sequence
  Description of Artificial Sequence: Synthetic oligonucleotide
  Description of Combined DNA/RNA Molecule: Synthetic oligonucleotide
caugugaccaugaggaaauga

SEQ ID NO: 3723 - RNA, 21 nt, Artificial Sequence
  Description of Artificial Sequence: Synthetic oligonucleotide
  Description of Combined DNA/RNA Molecule: Synthetic oligonucleotide
accaugaggaaaugagagaaa

SEQ ID NO: 3724 - RNA, 21 nt, Artificial Sequence
  Description of Artificial Sequence: Synthetic oligonucleotide
  Description of Combined DNA/RNA Molecule: Synthetic oligonucleotide
ugagagaaaugcuuacacaca

SEQ ID NO: 3725 - RNA, 21 nt, Artificial Sequence
  Description of Artificial Sequence: Synthetic oligonucleotide
  Description of Combined DNA/RNA Molecule: Synthetic oligonucleotide
agaaaugcuuacacacagaaa

SEQ ID NO: 3726 - RNA, 21 nt, Artificial Sequence
  Description of Artificial Sequence: Synthetic oligonucleotide
  Description of Combined DNA/RNA Molecule: Synthetic oligonucleotide
gaaaugcuuacacacagaaau

SEQ ID NO: 3727 - RNA, 21 nt, Artificial Sequence
  Description of Artificial Sequence: Synthetic oligonucleotide
  Description of Combined DNA/RNA Molecule: Synthetic oligonucleotide
cagaaauggccuugugaaaaa

SEQ ID NO: 3728 - RNA, 21 nt, Artificial Sequence
  Description of Artificial Sequence: Synthetic oligonucleotide
  Description of Combined DNA/RNA Molecule: Synthetic oligonucleotide
agaaauggccuugugaaaaag

SEQ ID NO: 3729 - RNA, 21 nt, Artificial Sequence
  Description of Artificial Sequence: Synthetic oligonucleotide
  Description of Combined DNA/RNA Molecule: Synthetic oligonucleotide
gaaauggccuugugaaaaagg

SEQ ID NO: 3730 - RNA, 21 nt, Artificial Sequence
  Description of Artificial Sequence: Synthetic oligonucleotide
  Description of Combined DNA/RNA Molecule: Synthetic oligonucleotide
aaauggccuugugaaaaaggg

SEQ ID NO: 3731 - RNA, 21 nt, Artificial Sequence
  Description of Artificial Sequence: Synthetic oligonucleotide
  Description of Combined DNA/RNA Molecule: Synthetic oligonucleotide
gccuugugaaaaaggguaaag

SEQ ID NO: 3732 - RNA, 21 nt, Artificial Sequence
  Description of Artificial Sequence: Synthetic oligonucleotide
  Description of Combined DNA/RNA Molecule: Synthetic oligonucleotide
uaaagaacaaaacacacagcg

SEQ ID NO: 3733 - RNA, 21 nt, Artificial Sequence
  Description of Artificial Sequence: Synthetic oligonucleotide
  Description of Combined DNA/RNA Molecule: Synthetic oligonucleotide
agcuuuuuucucagaaugaag

SEQ ID NO: 3734 - RNA, 21 nt, Artificial Sequence
  Description of Artificial Sequence: Synthetic oligonucleotide
  Description of Combined DNA/RNA Molecule: Synthetic oligonucleotide
cuuuuuucucagaaugaagug

SEQ ID NO: 3735 - RNA, 21 nt, Artificial Sequence
  Description of Artificial Sequence: Synthetic oligonucleotide
  Description of Combined DNA/RNA Molecule: Synthetic oligonucleotide
agaaugaaguguacccuaacu

SEQ ID NO: 3736 - RNA, 21 nt, Artificial Sequence
  Description of Artificial Sequence: Synthetic oligonucleotide
  Description of Combined DNA/RNA Molecule: Synthetic oligonucleotide
cgaggaagaacuaugaacaua

SEQ ID NO: 3737 - RNA, 21 nt, Artificial Sequence
  Description of Artificial Sequence: Synthetic oligonucleotide
  Description of Combined DNA/RNA Molecule: Synthetic oligonucleotide
gaggaagaacuaugaacauaa

SEQ ID NO: 3738 - RNA, 21 nt, Artificial Sequence
  Description of Artificial Sequence: Synthetic oligonucleotide
  Description of Combined DNA/RNA Molecule: Synthetic oligonucleotide
aggaagaacuaugaacauaaa

SEQ ID NO: 3739 - RNA, 21 nt, Artificial Sequence
  Description of Artificial Sequence: Synthetic oligonucleotide
  Description of Combined DNA/RNA Molecule: Synthetic oligonucleotide
cacaggccacauucacguaua

SEQ ID NO: 3740 - RNA, 21 nt, Artificial Sequence
  Description of Artificial Sequence: Synthetic oligonucleotide
  Description of Combined DNA/RNA Molecule: Synthetic oligonucleotide
uguggguauaagaaaccaccu

SEQ ID NO: 3741 - RNA, 21 nt, Artificial Sequence
  Description of Artificial Sequence: Synthetic oligonucleotide
  Description of Combined DNA/RNA Molecule: Synthetic oligonucleotide
guggguauaagaaaccaccua

SEQ ID NO: 3742 - RNA, 21 nt, Artificial Sequence
  Description of Artificial Sequence: Synthetic oligonucleotide
  Description of Combined DNA/RNA Molecule: Synthetic oligonucleotide
aaauauugaaauuccuuuaga

SEQ ID NO: 3743 - RNA, 21 nt, Artificial Sequence
  Description of Artificial Sequence: Synthetic oligonucleotide
  Description of Combined DNA/RNA Molecule: Synthetic oligonucleotide
ugaaauuccuuuagauagcaa

SEQ ID NO: 3744 - RNA, 21 nt, Artificial Sequence
  Description of Artificial Sequence: Synthetic oligonucleotide
  Description of Combined DNA/RNA Molecule: Synthetic oligonucleotide
uggauaugaaauuuucuuauu

SEQ ID NO: 3745 - RNA, 21 nt, Artificial Sequence
  Description of Artificial Sequence: Synthetic oligonucleotide
  Description of Combined DNA/RNA Molecule: Synthetic oligonucleotide
auaugaaauuuucuuauugug

SEQ ID NO: 3746 - RNA, 21 nt, Artificial Sequence
  Description of Artificial Sequence: Synthetic oligonucleotide
  Description of Combined DNA/RNA Molecule: Synthetic oligonucleotide
uaugaaauuuucuuauuguga

SEQ ID NO: 3747 - RNA, 21 nt, Artificial Sequence
  Description of Artificial Sequence: Synthetic oligonucleotide
  Description of Combined DNA/RNA Molecule: Synthetic oligonucleotide
augaaauuuucuuauugugau

SEQ ID NO: 3748 - RNA, 21 nt, Artificial Sequence
  Description of Artificial Sequence: Synthetic oligonucleotide
  Description of Combined DNA/RNA Molecule: Synthetic oligonucleotide
gaaauuuucuuauugugauga

SEQ ID NO: 3749 - RNA, 21 nt, Artificial Sequence
  Description of Artificial Sequence: Synthetic oligonucleotide
  Description of Combined DNA/RNA Molecule: Synthetic oligonucleotide
aaauuuucuuauugugaugaa

SEQ ID NO: 3750 - RNA, 21 nt, Artificial Sequence
  Description of Artificial Sequence: Synthetic oligonucleotide
  Description of Combined DNA/RNA Molecule: Synthetic oligonucleotide
aauuuucuuauugugaugaaa

SEQ ID NO: 3751 - RNA, 21 nt, Artificial Sequence
  Description of Artificial Sequence: Synthetic oligonucleotide
  Description of Combined DNA/RNA Molecule: Synthetic oligonucleotide
uucuuauugugaugaaagaau

SEQ ID NO: 3752 - RNA, 21 nt, Artificial Sequence
  Description of Artificial Sequence: Synthetic oligonucleotide
  Description of Combined DNA/RNA Molecule: Synthetic oligonucleotide
auugugaugaaagaauuaccg

SEQ ID NO: 3753 - RNA, 21 nt, Artificial Sequence
  Description of Artificial Sequence: Synthetic oligonucleotide
  Description of Combined DNA/RNA Molecule: Synthetic oligonucleotide
ugugaugaaagaauuaccgaa

SEQ ID NO: 3754 - RNA, 21 nt, Artificial Sequence
  Description of Artificial Sequence: Synthetic oligonucleotide
  Description of Combined DNA/RNA Molecule: Synthetic oligonucleotide
ugaaagaauuaccgaauugau

SEQ ID NO: 3755 - RNA, 21 nt, Artificial Sequence
  Description of Artificial Sequence: Synthetic oligonucleotide
  Description of Combined DNA/RNA Molecule: Synthetic oligonucleotide
gaaagaauuaccgaauugaug

SEQ ID NO: 3756 - RNA, 21 nt, Artificial Sequence
  Description of Artificial Sequence: Synthetic oligonucleotide
  Description of Combined DNA/RNA Molecule: Synthetic oligonucleotide
aaagaauuaccgaauugaugg

SEQ ID NO: 3757 - RNA, 21 nt, Artificial Sequence
  Description of Artificial Sequence: Synthetic oligonucleotide
  Description of Combined DNA/RNA Molecule: Synthetic oligonucleotide
aagaauuaccgaauugauggg

SEQ ID NO: 3758 - RNA, 21 nt, Artificial Sequence
  Description of Artificial Sequence: Synthetic oligonucleotide
  Description of Combined DNA/RNA Molecule: Synthetic oligonucleotide
ugaugggauaugagccagaag

SEQ ID NO: 3759 - RNA, 21 nt, Artificial Sequence
  Description of Artificial Sequence: Synthetic oligonucleotide
  Description of Combined DNA/RNA Molecule: Synthetic oligonucleotide
auaugagccagaagaacuuuu

SEQ ID NO: 3760 - RNA, 21 nt, Artificial Sequence
  Description of Artificial Sequence: Synthetic oligonucleotide
  Description of Combined DNA/RNA Molecule: Synthetic oligonucleotide
uuuaggccgcucaauuuauga

SEQ ID NO: 3761 - RNA, 21 nt, Artificial Sequence
  Description of Artificial Sequence: Synthetic oligonucleotide
  Description of Combined DNA/RNA Molecule: Synthetic oligonucleotide
uuuaugaauauuaucaugcuu

SEQ ID NO: 3762 - RNA, 21 nt, Artificial Sequence
  Description of Artificial Sequence: Synthetic oligonucleotide
  Description of Combined DNA/RNA Molecule: Synthetic oligonucleotide
uaugaauauuaucaugcuuug

SEQ ID NO: 3763 - RNA, 21 nt, Artificial Sequence
  Description of Artificial Sequence: Synthetic oligonucleotide
  Description of Combined DNA/RNA Molecule: Synthetic oligonucleotide
aucugaccaaaacucaucaug

SEQ ID NO: 3764 - RNA, 21 nt, Artificial Sequence
  Description of Artificial Sequence: Synthetic oligonucleotide
  Description of Combined DNA/RNA Molecule: Synthetic oligonucleotide
accaaaacucaucaugauaug

SEQ ID NO: 3765 - RNA, 21 nt, Artificial Sequence
  Description of Artificial Sequence: Synthetic oligonucleotide
  Description of Combined DNA/RNA Molecule: Synthetic oligonucleotide
ccaaaacucaucaugauaugu

SEQ ID NO: 3766 - RNA, 21 nt, Artificial Sequence
  Description of Artificial Sequence: Synthetic oligonucleotide
  Description of Combined DNA/RNA Molecule: Synthetic oligonucleotide
aucaugauauguuuacuaaag

SEQ ID NO: 3767 - RNA, 21 nt, Artificial Sequence
  Description of Artificial Sequence: Synthetic oligonucleotide
  Description of Combined DNA/RNA Molecule: Synthetic oligonucleotide
ugauauguuuacuaaaggaca

SEQ ID NO: 3768 - RNA, 21 nt, Artificial Sequence
  Description of Artificial Sequence: Synthetic oligonucleotide
  Description of Combined DNA/RNA Molecule: Synthetic oligonucleotide
gagguggauaugucuggguug

SEQ ID NO: 3769 - RNA, 21 nt, Artificial Sequence
  Description of Artificial Sequence: Synthetic oligonucleotide
  Description of Combined DNA/RNA Molecule: Synthetic oligonucleotide
uggguugaaacucaagcaacu

SEQ ID NO: 3770 - RNA, 21 nt, Artificial Sequence
  Description of Artificial Sequence: Synthetic oligonucleotide
  Description of Combined DNA/RNA Molecule: Synthetic oligonucleotide
aacugucauauauaacaccaa

SEQ ID NO: 3771 - RNA, 21 nt, Artificial Sequence
  Description of Artificial Sequence: Synthetic oligonucleotide
  Description of Combined DNA/RNA Molecule: Synthetic oligonucleotide
accaagaauucucaaccacag

SEQ ID NO: 3772 - RNA, 21 nt, Artificial Sequence
  Description of Artificial Sequence: Synthetic oligonucleotide
  Description of Combined DNA/RNA Molecule: Synthetic oligonucleotide
cacagugcauuguauguguga

SEQ ID NO: 3773 - RNA, 21 nt, Artificial Sequence
  Description of Artificial Sequence: Synthetic oligonucleotide
  Description of Combined DNA/RNA Molecule: Synthetic oligonucleotide
acagugcauuguaugugugaa

SEQ ID NO: 3774 - RNA, 21 nt, Artificial Sequence
  Description of Artificial Sequence: Synthetic oligonucleotide
  Description of Combined DNA/RNA Molecule: Synthetic oligonucleotide
augugugaauuacguugugag

SEQ ID NO: 3775 - RNA, 21 nt, Artificial Sequence
  Description of Artificial Sequence: Synthetic oligonucleotide
  Description of Combined DNA/RNA Molecule: Synthetic oligonucleotide
ugugugaauuacguugugagu

SEQ ID NO: 3776 - RNA, 21 nt, Artificial Sequence
  Description of Artificial Sequence: Synthetic oligonucleotide
  Description of Combined DNA/RNA Molecule: Synthetic oligonucleotide
gugugaauuacguugugagug

SEQ ID NO: 3777 - RNA, 21 nt, Artificial Sequence
  Description of Artificial Sequence: Synthetic oligonucleotide
  Description of Combined DNA/RNA Molecule: Synthetic oligonucleotide
ugugaauuacguugugagugg

SEQ ID NO: 3778 - RNA, 21 nt, Artificial Sequence
  Description of Artificial Sequence: Synthetic oligonucleotide
  Description of Combined DNA/RNA Molecule: Synthetic oligonucleotide
ugguauuauucagcacgacuu

SEQ ID NO: 3779 - RNA, 21 nt, Artificial Sequence
  Description of Artificial Sequence: Synthetic oligonucleotide
  Description of Combined DNA/RNA Molecule: Synthetic oligonucleotide
cuugauuuucucccuucaaca

SEQ ID NO: 3780 - RNA, 21 nt, Artificial Sequence
  Description of Artificial Sequence: Synthetic oligonucleotide
  Description of Combined DNA/RNA Molecule: Synthetic oligonucleotide
aacaaacagaauguguccuua

SEQ ID NO: 3781 - RNA, 21 nt, Artificial Sequence
  Description of Artificial Sequence: Synthetic oligonucleotide
  Description of Combined DNA/RNA Molecule: Synthetic oligonucleotide
aauguguccuuaaaccgguug

SEQ ID NO: 3782 - RNA, 21 nt, Artificial Sequence
  Description of Artificial Sequence: Synthetic oligonucleotide
  Description of Combined DNA/RNA Molecule: Synthetic oligonucleotide
accgguugaaucuucagauau

SEQ ID NO: 3783 - RNA, 21 nt, Artificial Sequence
  Description of Artificial Sequence: Synthetic oligonucleotide
  Description of Combined DNA/RNA Molecule: Synthetic oligonucleotide
ccgguugaaucuucagauaug

SEQ ID NO: 3784 - RNA, 21 nt, Artificial Sequence
  Description of Artificial Sequence: Synthetic oligonucleotide
  Description of Combined DNA/RNA Molecule: Synthetic oligonucleotide
cgguugaaucuucagauauga

SEQ ID NO: 3785 - RNA, 21 nt, Artificial Sequence
  Description of Artificial Sequence: Synthetic oligonucleotide
  Description of Combined DNA/RNA Molecule: Synthetic oligonucleotide
guugaaucuucagauaugaaa

SEQ ID NO: 3786 - RNA, 21 nt, Artificial Sequence
  Description of Artificial Sequence: Synthetic oligonucleotide
  Description of Combined DNA/RNA Molecule: Synthetic oligonucleotide
uugaaucuucagauaugaaaa

SEQ ID NO: 3787 - RNA, 21 nt, Artificial Sequence
  Description of Artificial Sequence: Synthetic oligonucleotide
  Description of Combined DNA/RNA Molecule: Synthetic oligonucleotide
agauaugaaaaugacucagcu

SEQ ID NO: 3788 - RNA, 21 nt, Artificial Sequence
  Description of Artificial Sequence: Synthetic oligonucleotide
  Description of Combined DNA/RNA Molecule: Synthetic oligonucleotide
gauaugaaaaugacucagcua

SEQ ID NO: 3789 - RNA, 21 nt, Artificial Sequence
  Description of Artificial Sequence: Synthetic oligonucleotide
  Description of Combined DNA/RNA Molecule: Synthetic oligonucleotide
aaaguugaaucagaagauaca

SEQ ID NO: 3790 - RNA, 21 nt, Artificial Sequence
  Description of Artificial Sequence: Synthetic oligonucleotide
  Description of Combined DNA/RNA Molecule: Synthetic oligonucleotide
aguugaaucagaagauacaag

SEQ ID NO: 3791 - RNA, 21 nt, Artificial Sequence
  Description of Artificial Sequence: Synthetic oligonucleotide
  Description of Combined DNA/RNA Molecule: Synthetic oligonucleotide
cagaagauacaaguagccucu

SEQ ID NO: 3792 - RNA, 21 nt, Artificial Sequence
  Description of Artificial Sequence: Synthetic oligonucleotide
  Description of Combined DNA/RNA Molecule: Synthetic oligonucleotide
agaagauacaaguagccucuu

SEQ ID NO: 3793 - RNA, 21 nt, Artificial Sequence
  Description of Artificial Sequence: Synthetic oligonucleotide
  Description of Combined DNA/RNA Molecule: Synthetic oligonucleotide
gaagauacaaguagccucuuu

SEQ ID NO: 3794 - RNA, 21 nt, Artificial Sequence
  Description of Artificial Sequence: Synthetic oligonucleotide
  Description of Combined DNA/RNA Molecule: Synthetic oligonucleotide
cucuuugacaaacuuaagaag

SEQ ID NO: 3795 - RNA, 21 nt, Artificial Sequence
  Description of Artificial Sequence: Synthetic oligonucleotide
  Description of Combined DNA/RNA Molecule: Synthetic oligonucleotide
ucuuugacaaacuuaagaagg

SEQ ID NO: 3796 - RNA, 21 nt, Artificial Sequence
  Description of Artificial Sequence: Synthetic oligonucleotide
  Description of Combined DNA/RNA Molecule: Synthetic oligonucleotide
accugaugcuuuaacuuugcu

SEQ ID NO: 3797 - RNA, 21 nt, Artificial Sequence
  Description of Artificial Sequence: Synthetic oligonucleotide
  Description of Combined DNA/RNA Molecule: Synthetic oligonucleotide
cuggagacacaaucauaucuu

SEQ ID NO: 3798 - RNA, 21 nt, Artificial Sequence
  Description of Artificial Sequence: Synthetic oligonucleotide
  Description of Combined DNA/RNA Molecule: Synthetic oligonucleotide
uggagacacaaucauaucuuu

SEQ ID NO: 3799 - RNA, 21 nt, Artificial Sequence
  Description of Artificial Sequence: Synthetic oligonucleotide
  Description of Combined DNA/RNA Molecule: Synthetic oligonucleotide
aacuugaggaaguaccauuau

SEQ ID NO: 3800 - RNA, 21 nt, Artificial Sequence
  Description of Artificial Sequence: Synthetic oligonucleotide
  Description of Combined DNA/RNA Molecule: Synthetic oligonucleotide
acuugaggaaguaccauuaua

SEQ ID NO: 3801 - RNA, 21 nt, Artificial Sequence
  Description of Artificial Sequence: Synthetic oligonucleotide
  Description of Combined DNA/RNA Molecule: Synthetic oligonucleotide
uugaggaaguaccauuauaua

SEQ ID NO: 3802 - RNA, 21 nt, Artificial Sequence
  Description of Artificial Sequence: Synthetic oligonucleotide
  Description of Combined DNA/RNA Molecule: Synthetic oligonucleotide
ugaggaaguaccauuauauaa

SEQ ID NO: 3803 - RNA, 21 nt, Artificial Sequence
  Description of Artificial Sequence: Synthetic oligonucleotide
  Description of Combined DNA/RNA Molecule: Synthetic oligonucleotide
aggaaguaccauuauauaaug

SEQ ID NO: 3804 - RNA, 21 nt, Artificial Sequence
  Description of Artificial Sequence: Synthetic oligonucleotide
  Description of Combined DNA/RNA Molecule: Synthetic oligonucleotide
ggaaguaccauuauauaauga

SEQ ID NO: 3805 - RNA, 21 nt, Artificial Sequence
  Description of Artificial Sequence: Synthetic oligonucleotide
  Description of Combined DNA/RNA Molecule: Synthetic oligonucleotide
aacgaaaaauuacagaauaua

SEQ ID NO: 3806 - RNA, 21 nt, Artificial Sequence
  Description of Artificial Sequence: Synthetic oligonucleotide
  Description of Combined DNA/RNA Molecule: Synthetic oligonucleotide
acgaaaaauuacagaauauaa

SEQ ID NO: 3807 - RNA, 21 nt, Artificial Sequence
  Description of Artificial Sequence: Synthetic oligonucleotide
  Description of Combined DNA/RNA Molecule: Synthetic oligonucleotide
aaaaauuacagaauauaaauu

SEQ ID NO: 3808 - RNA, 21 nt, Artificial Sequence
  Description of Artificial Sequence: Synthetic oligonucleotide
  Description of Combined DNA/RNA Molecule: Synthetic oligonucleotide
uacagaauauaaauuuggcaa

SEQ ID NO: 3809 - RNA, 21 nt, Artificial Sequence
  Description of Artificial Sequence: Synthetic oligonucleotide
  Description of Combined DNA/RNA Molecule: Synthetic oligonucleotide
acagaauauaaauuuggcaau

SEQ ID NO: 3810 - RNA, 21 nt, Artificial Sequence
  Description of Artificial Sequence: Synthetic oligonucleotide
  Description of Combined DNA/RNA Molecule: Synthetic oligonucleotide
aucaagaaguugcauuaaaau

SEQ ID NO: 3811 - RNA, 21 nt, Artificial Sequence
  Description of Artificial Sequence: Synthetic oligonucleotide
  Description of Combined DNA/RNA Molecule: Synthetic oligonucleotide
ucaagaaguugcauuaaaauu

SEQ ID NO: 3812 - RNA, 21 nt, Artificial Sequence
  Description of Artificial Sequence: Synthetic oligonucleotide
  Description of Combined DNA/RNA Molecule: Synthetic oligonucleotide
uaaaauuagaaccaaauccag

SEQ ID NO: 3813 - RNA, 21 nt, Artificial Sequence
  Description of Artificial Sequence: Synthetic oligonucleotide
  Description of Combined DNA/RNA Molecule: Synthetic oligonucleotide
aaaauuagaaccaaauccaga

SEQ ID NO: 3814 - RNA, 21 nt, Artificial Sequence
  Description of Artificial Sequence: Synthetic oligonucleotide
  Description of Combined DNA/RNA Molecule: Synthetic oligonucleotide
ccagagucacuggaacuuucu

SEQ ID NO: 3815 - RNA, 21 nt, Artificial Sequence
  Description of Artificial Sequence: Synthetic oligonucleotide
  Description of Combined DNA/RNA Molecule: Synthetic oligonucleotide
cagagucacuggaacuuucuu

SEQ ID NO: 3816 - RNA, 21 nt, Artificial Sequence
  Description of Artificial Sequence: Synthetic oligonucleotide
  Description of Combined DNA/RNA Molecule: Synthetic oligonucleotide
cacuggaacuuucuuuuacca

SEQ ID NO: 3817 - RNA, 21 nt, Artificial Sequence
  Description of Artificial Sequence: Synthetic oligonucleotide
  Description of Combined DNA/RNA Molecule: Synthetic oligonucleotide
gccuaauagucccagugaaua

SEQ ID NO: 3818 - RNA, 21 nt, Artificial Sequence
  Description of Artificial Sequence: Synthetic oligonucleotide
  Description of Combined DNA/RNA Molecule: Synthetic oligonucleotide
ccuaauagucccagugaauau

SEQ ID NO: 3819 - RNA, 21 nt, Artificial Sequence
  Description of Artificial Sequence: Synthetic oligonucleotide
  Description of Combined DNA/RNA Molecule: Synthetic oligonucleotide
cuaauagucccagugaauauu

SEQ ID NO: 3820 - RNA, 21 nt, Artificial Sequence
  Description of Artificial Sequence: Synthetic oligonucleotide
  Description of Combined DNA/RNA Molecule: Synthetic oligonucleotide
uaauagucccagugaauauug

SEQ ID NO: 3821 - RNA, 21 nt, Artificial Sequence
  Description of Artificial Sequence: Synthetic oligonucleotide
  Description of Combined DNA/RNA Molecule: Synthetic oligonucleotide
aauagucccagugaauauugu

SEQ ID NO: 3822 - RNA, 21 nt, Artificial Sequence
  Description of Artificial Sequence: Synthetic oligonucleotide
  Description of Combined DNA/RNA Molecule: Synthetic oligonucleotide
cagugaauauuguuuuuaugu

SEQ ID NO: 3823 - RNA, 21 nt, Artificial Sequence
  Description of Artificial Sequence: Synthetic oligonucleotide
  Description of Combined DNA/RNA Molecule: Synthetic oligonucleotide
agugaauauuguuuuuaugug

SEQ ID NO: 3824 - RNA, 21 nt, Artificial Sequence
  Description of Artificial Sequence: Synthetic oligonucleotide
  Description of Combined DNA/RNA Molecule: Synthetic oligonucleotide
ugaauauuguuuuuaugugga

SEQ ID NO: 3825 - RNA, 21 nt, Artificial Sequence
  Description of Artificial Sequence: Synthetic oligonucleotide
  Description of Combined DNA/RNA Molecule: Synthetic oligonucleotide
aauauuguuuuuauguggaua

SEQ ID NO: 3826 - RNA, 21 nt, Artificial Sequence
  Description of Artificial Sequence: Synthetic oligonucleotide
  Description of Combined DNA/RNA Molecule: Synthetic oligonucleotide
auauuguuuuuauguggauag

SEQ ID NO: 3827 - RNA, 21 nt, Artificial Sequence
  Description of Artificial Sequence: Synthetic oligonucleotide
  Description of Combined DNA/RNA Molecule: Synthetic oligonucleotide
auuguuuuuauguggauagug

SEQ ID NO: 3828 - RNA, 21 nt, Artificial Sequence
  Description of Artificial Sequence: Synthetic oligonucleotide
  Description of Combined DNA/RNA Molecule: Synthetic oligonucleotide
guuuuuauguggauagugaua

SEQ ID NO: 3829 - RNA, 21 nt, Artificial Sequence
  Description of Artificial Sequence: Synthetic oligonucleotide
  Description of Combined DNA/RNA Molecule: Synthetic oligonucleotide
uguggauagugauauggucaa

SEQ ID NO: 3830 - RNA, 21 nt, Artificial Sequence
  Description of Artificial Sequence: Synthetic oligonucleotide
  Description of Combined DNA/RNA Molecule: Synthetic oligonucleotide
uggauagugauauggucaaug

SEQ ID NO: 3831 - RNA, 21 nt, Artificial Sequence
  Description of Artificial Sequence: Synthetic oligonucleotide
  Description of Combined DNA/RNA Molecule: Synthetic oligonucleotide
ggauagugauauggucaauga

SEQ ID NO: 3832 - RNA, 21 nt, Artificial Sequence
  Description of Artificial Sequence: Synthetic oligonucleotide
  Description of Combined DNA/RNA Molecule: Synthetic oligonucleotide
gauagugauauggucaaugaa

SEQ ID NO: 3833 - RNA, 21 nt, Artificial Sequence
  Description of Artificial Sequence: Synthetic oligonucleotide
  Description of Combined DNA/RNA Molecule: Synthetic oligonucleotide
gugauauggucaaugaauuca

SEQ ID NO: 3834 - RNA, 21 nt, Artificial Sequence
  Description of Artificial Sequence: Synthetic oligonucleotide
  Description of Combined DNA/RNA Molecule: Synthetic oligonucleotide
auauggucaaugaauucaagu

SEQ ID NO: 3835 - RNA, 21 nt, Artificial Sequence
  Description of Artificial Sequence: Synthetic oligonucleotide
  Description of Combined DNA/RNA Molecule: Synthetic oligonucleotide
uauggucaaugaauucaaguu

SEQ ID NO: 3836 - RNA, 21 nt, Artificial Sequence
  Description of Artificial Sequence: Synthetic oligonucleotide
  Description of Combined DNA/RNA Molecule: Synthetic oligonucleotide
ucaaugaauucaaguuggaau

SEQ ID NO: 3837 - RNA, 21 nt, Artificial Sequence
  Description of Artificial Sequence: Synthetic oligonucleotide
  Description of Combined DNA/RNA Molecule: Synthetic oligonucleotide
caaugaauucaaguuggaauu

SEQ ID NO: 3838 - RNA, 21 nt, Artificial Sequence
  Description of Artificial Sequence: Synthetic oligonucleotide
  Description of Combined DNA/RNA Molecule: Synthetic oligonucleotide
augaauucaaguuggaauugg

SEQ ID NO: 3839 - RNA, 21 nt, Artificial Sequence
  Description of Artificial Sequence: Synthetic oligonucleotide
  Description of Combined DNA/RNA Molecule: Synthetic oligonucleotide
ucaaguuggaauugguagaaa

SEQ ID NO: 3840 - RNA, 21 nt, Artificial Sequence
  Description of Artificial Sequence: Synthetic oligonucleotide
  Description of Combined DNA/RNA Molecule: Synthetic oligonucleotide
uggaauugguagaaaaacuuu

SEQ ID NO: 3841 - RNA, 21 nt, Artificial Sequence
  Description of Artificial Sequence: Synthetic oligonucleotide
  Description of Combined DNA/RNA Molecule: Synthetic oligonucleotide
ggaauugguagaaaaacuuuu

SEQ ID NO: 3842 - RNA, 21 nt, Artificial Sequence
  Description of Artificial Sequence: Synthetic oligonucleotide
  Description of Combined DNA/RNA Molecule: Synthetic oligonucleotide
gguagaaaaacuuuuugcuga

SEQ ID NO: 3843 - RNA, 21 nt, Artificial Sequence
  Description of Artificial Sequence: Synthetic oligonucleotide
  Description of Combined DNA/RNA Molecule: Synthetic oligonucleotide
guagaaaaacuuuuugcugaa

SEQ ID NO: 3844 - RNA, 21 nt, Artificial Sequence
  Description of Artificial Sequence: Synthetic oligonucleotide
  Description of Combined DNA/RNA Molecule: Synthetic oligonucleotide
aacuuuuugcugaagacacag

SEQ ID NO: 3845 - RNA, 21 nt, Artificial Sequence
  Description of Artificial Sequence: Synthetic oligonucleotide
  Description of Combined DNA/RNA Molecule: Synthetic oligonucleotide
ugcugaagacacagaagcaaa

SEQ ID NO: 3846 - RNA, 21 nt, Artificial Sequence
  Description of Artificial Sequence: Synthetic oligonucleotide
  Description of Combined DNA/RNA Molecule: Synthetic oligonucleotide
gcugaagacacagaagcaaag

SEQ ID NO: 3847 - RNA, 21 nt, Artificial Sequence
  Description of Artificial Sequence: Synthetic oligonucleotide
  Description of Combined DNA/RNA Molecule: Synthetic oligonucleotide
cacagaagcaaagaacccauu

SEQ ID NO: 3848 - RNA, 21 nt, Artificial Sequence
  Description of Artificial Sequence: Synthetic oligonucleotide
  Description of Combined DNA/RNA Molecule: Synthetic oligonucleotide
aaagaacccauuuucuacuca

SEQ ID NO: 3849 - RNA, 21 nt, Artificial Sequence
  Description of Artificial Sequence: Synthetic oligonucleotide
  Description of Combined DNA/RNA Molecule: Synthetic oligonucleotide
cucaggacacagauuuagacu

SEQ ID NO: 3850 - RNA, 21 nt, Artificial Sequence
  Description of Artificial Sequence: Synthetic oligonucleotide
  Description of Combined DNA/RNA Molecule: Synthetic oligonucleotide
cacagauuuagacuuggagau

SEQ ID NO: 3851 - RNA, 21 nt, Artificial Sequence
  Description of Artificial Sequence: Synthetic oligonucleotide
  Description of Combined DNA/RNA Molecule: Synthetic oligonucleotide
cagauuuagacuuggagaugu

SEQ ID NO: 3852 - RNA, 21 nt, Artificial Sequence
  Description of Artificial Sequence: Synthetic oligonucleotide
  Description of Combined DNA/RNA Molecule: Synthetic oligonucleotide
agauuuagacuuggagauguu

SEQ ID NO: 3853 - RNA, 21 nt, Artificial Sequence
  Description of Artificial Sequence: Synthetic oligonucleotide
  Description of Combined DNA/RNA Molecule: Synthetic oligonucleotide
uuggagauguuagcucccuau

SEQ ID NO: 3854 - RNA, 21 nt, Artificial Sequence
  Description of Artificial Sequence: Synthetic oligonucleotide
  Description of Combined DNA/RNA Molecule: Synthetic oligonucleotide
ggaugaugacuuccaguuacg

SEQ ID NO: 3855 - RNA, 21 nt, Artificial Sequence
  Description of Artificial Sequence: Synthetic oligonucleotide
  Description of Combined DNA/RNA Molecule: Synthetic oligonucleotide
uucgaucaguugucaccauua

SEQ ID NO: 3856 - RNA, 21 nt, Artificial Sequence
  Description of Artificial Sequence: Synthetic oligonucleotide
  Description of Combined DNA/RNA Molecule: Synthetic oligonucleotide
aguugucaccauuagaaagca

SEQ ID NO: 3857 - RNA, 21 nt, Artificial Sequence
  Description of Artificial Sequence: Synthetic oligonucleotide
  Description of Combined DNA/RNA Molecule: Synthetic oligonucleotide
cacaguuacaguauuccagca

SEQ ID NO: 3858 - RNA, 21 nt, Artificial Sequence
  Description of Artificial Sequence: Synthetic oligonucleotide
  Description of Combined DNA/RNA Molecule: Synthetic oligonucleotide
augaauuaaaaacagugacaa

SEQ ID NO: 3859 - RNA, 21 nt, Artificial Sequence
  Description of Artificial Sequence: Synthetic oligonucleotide
  Description of Combined DNA/RNA Molecule: Synthetic oligonucleotide
ugaauuaaaaacagugacaaa

SEQ ID NO: 3860 - RNA, 21 nt, Artificial Sequence
  Description of Artificial Sequence: Synthetic oligonucleotide
  Description of Combined DNA/RNA Molecule: Synthetic oligonucleotide
gaauuaaaaacagugacaaaa

SEQ ID NO: 3861 - RNA, 21 nt, Artificial Sequence
  Description of Artificial Sequence: Synthetic oligonucleotide
  Description of Combined DNA/RNA Molecule: Synthetic oligonucleotide
aacagugacaaaagaccguau

SEQ ID NO: 3862 - RNA, 21 nt, Artificial Sequence
  Description of Artificial Sequence: Synthetic oligonucleotide
  Description of Combined DNA/RNA Molecule: Synthetic oligonucleotide
cagugacaaaagaccguaugg

SEQ ID NO: 3863 - RNA, 21 nt, Artificial Sequence
  Description of Artificial Sequence: Synthetic oligonucleotide
  Description of Combined DNA/RNA Molecule: Synthetic oligonucleotide
accguauggaagacauuaaaa

SEQ ID NO: 3864 - RNA, 21 nt, Artificial Sequence
  Description of Artificial Sequence: Synthetic oligonucleotide
  Description of Combined DNA/RNA Molecule: Synthetic oligonucleotide
guauggaagacauuaaaauau

SEQ ID NO: 3865 - RNA, 21 nt, Artificial Sequence
  Description of Artificial Sequence: Synthetic oligonucleotide
  Description of Combined DNA/RNA Molecule: Synthetic oligonucleotide
uauggaagacauuaaaauauu

SEQ ID NO: 3866 - RNA, 21 nt, Artificial Sequence
  Description of Artificial Sequence: Synthetic oligonucleotide
  Description of Combined DNA/RNA Molecule: Synthetic oligonucleotide
uggaagacauuaaaauauuga

SEQ ID NO: 3867 - RNA, 21 nt, Artificial Sequence
  Description of Artificial Sequence: Synthetic oligonucleotide
  Description of Combined DNA/RNA Molecule: Synthetic oligonucleotide
auauagagauacucaaagucg

SEQ ID NO: 3868 - RNA, 21 nt, Artificial Sequence
  Description of Artificial Sequence: Synthetic oligonucleotide
  Description of Combined DNA/RNA Molecule: Synthetic oligonucleotide
aggaaaaggagucauagaaca

SEQ ID NO: 3869 - RNA, 21 nt, Artificial Sequence
  Description of Artificial Sequence: Synthetic oligonucleotide
  Description of Combined DNA/RNA Molecule: Synthetic oligonucleotide
aaaggagucauagaacagaca

SEQ ID NO: 3870 - RNA, 21 nt, Artificial Sequence
  Description of Artificial Sequence: Synthetic oligonucleotide
  Description of Combined DNA/RNA Molecule: Synthetic oligonucleotide
aaggagucauagaacagacag

SEQ ID NO: 3871 - RNA, 21 nt, Artificial Sequence
  Description of Artificial Sequence: Synthetic oligonucleotide
  Description of Combined DNA/RNA Molecule: Synthetic oligonucleotide
gacagaaaaaucucauccaag

SEQ ID NO: 3872 - RNA, 21 nt, Artificial Sequence
  Description of Artificial Sequence: Synthetic oligonucleotide
  Description of Combined DNA/RNA Molecule: Synthetic oligonucleotide
acagaaaaaucucauccaaga

SEQ ID NO: 3873 - RNA, 21 nt, Artificial Sequence
  Description of Artificial Sequence: Synthetic oligonucleotide
  Description of Combined DNA/RNA Molecule: Synthetic oligonucleotide
aacguguuaucugucgcuuug

SEQ ID NO: 3874 - RNA, 21 nt, Artificial Sequence
  Description of Artificial Sequence: Synthetic oligonucleotide
  Description of Combined DNA/RNA Molecule: Synthetic oligonucleotide
acguguuaucugucgcuuuga

SEQ ID NO: 3875 - RNA, 21 nt, Artificial Sequence
  Description of Artificial Sequence: Synthetic oligonucleotide
  Description of Combined DNA/RNA Molecule: Synthetic oligonucleotide
aucugucgcuuugagucaaag

SEQ ID NO: 3876 - RNA, 21 nt, Artificial Sequence
  Description of Artificial Sequence: Synthetic oligonucleotide
  Description of Combined DNA/RNA Molecule: Synthetic oligonucleotide
gcuuugagucaaagaacuaca

SEQ ID NO: 3877 - RNA, 21 nt, Artificial Sequence
  Description of Artificial Sequence: Synthetic oligonucleotide
  Description of Combined DNA/RNA Molecule: Synthetic oligonucleotide
cuuugagucaaagaacuacag

SEQ ID NO: 3878 - RNA, 21 nt, Artificial Sequence
  Description of Artificial Sequence: Synthetic oligonucleotide
  Description of Combined DNA/RNA Molecule: Synthetic oligonucleotide
gucaaagaacuacaguuccug

SEQ ID NO: 3879 - RNA, 21 nt, Artificial Sequence
  Description of Artificial Sequence: Synthetic oligonucleotide
  Description of Combined DNA/RNA Molecule: Synthetic oligonucleotide
ucaaagaacuacaguuccuga

SEQ ID NO: 3880 - RNA, 21 nt, Artificial Sequence
  Description of Artificial Sequence: Synthetic oligonucleotide
  Description of Combined DNA/RNA Molecule: Synthetic oligonucleotide
cugaggaagaacuaaauccaa

SEQ ID NO: 3881 - RNA, 21 nt, Artificial Sequence
  Description of Artificial Sequence: Synthetic oligonucleotide
  Description of Combined DNA/RNA Molecule: Synthetic oligonucleotide
ugaggaagaacuaaauccaaa

SEQ ID NO: 3882 - RNA, 21 nt, Artificial Sequence
  Description of Artificial Sequence: Synthetic oligonucleotide
  Description of Combined DNA/RNA Molecule: Synthetic oligonucleotide
gaggaagaacuaaauccaaag

SEQ ID NO: 3883 - RNA, 21 nt, Artificial Sequence
  Description of Artificial Sequence: Synthetic oligonucleotide
  Description of Combined DNA/RNA Molecule: Synthetic oligonucleotide
aggaagaacuaaauccaaaga

SEQ ID NO: 3884 - RNA, 21 nt, Artificial Sequence
  Description of Artificial Sequence: Synthetic oligonucleotide
  Description of Combined DNA/RNA Molecule: Synthetic oligonucleotide
cuaaauccaaagauacuagcu

SEQ ID NO: 3885 - RNA, 21 nt, Artificial Sequence
  Description of Artificial Sequence: Synthetic oligonucleotide
  Description of Combined DNA/RNA Molecule: Synthetic oligonucleotide
uccaaagauacuagcuuugca

SEQ ID NO: 3886 - RNA, 21 nt, Artificial Sequence
  Description of Artificial Sequence: Synthetic oligonucleotide
  Description of Combined DNA/RNA Molecule: Synthetic oligonucleotide
caaagauacuagcuuugcaga

SEQ ID NO: 3887 - RNA, 21 nt, Artificial Sequence
  Description of Artificial Sequence: Synthetic oligonucleotide
  Description of Combined DNA/RNA Molecule: Synthetic oligonucleotide
aaagauacuagcuuugcagaa

SEQ ID NO: 3888 - RNA, 21 nt, Artificial Sequence
  Description of Artificial Sequence: Synthetic oligonucleotide
  Description of Combined DNA/RNA Molecule: Synthetic oligonucleotide
gagaaagcgaaaaauggaaca

SEQ ID NO: 3889 - RNA, 21 nt, Artificial Sequence
  Description of Artificial Sequence: Synthetic oligonucleotide
  Description of Combined DNA/RNA Molecule: Synthetic oligonucleotide
aauggaacaugaugguucacu

SEQ ID NO: 3890 - RNA, 21 nt, Artificial Sequence
  Description of Artificial Sequence: Synthetic oligonucleotide
  Description of Combined DNA/RNA Molecule: Synthetic oligonucleotide
acaugaugguucacuuuuuca

SEQ ID NO: 3891 - RNA, 21 nt, Artificial Sequence
  Description of Artificial Sequence: Synthetic oligonucleotide
  Description of Combined DNA/RNA Molecule: Synthetic oligonucleotide
acuuuuucaagcaguaggaau

SEQ ID NO: 3892 - RNA, 21 nt, Artificial Sequence
  Description of Artificial Sequence: Synthetic oligonucleotide
  Description of Combined DNA/RNA Molecule: Synthetic oligonucleotide
agcaguaggaauuggaacauu

SEQ ID NO: 3893 - RNA, 21 nt, Artificial Sequence
  Description of Artificial Sequence: Synthetic oligonucleotide
  Description of Combined DNA/RNA Molecule: Synthetic oligonucleotide
gcaguaggaauuggaacauua

SEQ ID NO: 3894 - RNA, 21 nt, Artificial Sequence
  Description of Artificial Sequence: Synthetic oligonucleotide
  Description of Combined DNA/RNA Molecule: Synthetic oligonucleotide
caguaggaauuggaacauuau

SEQ ID NO: 3895 - RNA, 21 nt, Artificial Sequence
  Description of Artificial Sequence: Synthetic oligonucleotide
  Description of Combined DNA/RNA Molecule: Synthetic oligonucleotide
uucuuggaaacguguaaaagg

SEQ ID NO: 3896 - RNA, 21 nt, Artificial Sequence
  Description of Artificial Sequence: Synthetic oligonucleotide
  Description of Combined DNA/RNA Molecule: Synthetic oligonucleotide
ucuuggaaacguguaaaagga

SEQ ID NO: 3897 - RNA, 21 nt, Artificial Sequence
  Description of Artificial Sequence: Synthetic oligonucleotide
  Description of Combined DNA/RNA Molecule: Synthetic oligonucleotide
uguaaaaggaugcaaaucuag

SEQ ID NO: 3898 - RNA, 21 nt, Artificial Sequence
  Description of Artificial Sequence: Synthetic oligonucleotide
  Description of Combined DNA/RNA Molecule: Synthetic oligonucleotide
guaaaaggaugcaaaucuagu

SEQ ID NO: 3899 - RNA, 21 nt, Artificial Sequence
  Description of Artificial Sequence: Synthetic oligonucleotide
  Description of Combined DNA/RNA Molecule: Synthetic oligonucleotide
aggaugcaaaucuagugaaca

SEQ ID NO: 3900 - RNA, 21 nt, Artificial Sequence
  Description of Artificial Sequence: Synthetic oligonucleotide
  Description of Combined DNA/RNA Molecule: Synthetic oligonucleotide
ugcaaaucuagugaacagaau

SEQ ID NO: 3901 - RNA, 21 nt, Artificial Sequence
  Description of Artificial Sequence: Synthetic oligonucleotide
  Description of Combined DNA/RNA Molecule: Synthetic oligonucleotide
ucuagugaacagaauggaaug

SEQ ID NO: 3902 - RNA, 21 nt, Artificial Sequence
  Description of Artificial Sequence: Synthetic oligonucleotide
  Description of Combined DNA/RNA Molecule: Synthetic oligonucleotide
cuagugaacagaauggaaugg

SEQ ID NO: 3903 - RNA, 21 nt, Artificial Sequence
  Description of Artificial Sequence: Synthetic oligonucleotide
  Description of Combined DNA/RNA Molecule: Synthetic oligonucleotide
acagaauggaauggagcaaaa

SEQ ID NO: 3904 - RNA, 21 nt, Artificial Sequence
  Description of Artificial Sequence: Synthetic oligonucleotide
  Description of Combined DNA/RNA Molecule: Synthetic oligonucleotide
auggaauggagcaaaagacaa

SEQ ID NO: 3905 - RNA, 21 nt, Artificial Sequence
  Description of Artificial Sequence: Synthetic oligonucleotide
  Description of Combined DNA/RNA Molecule: Synthetic oligonucleotide
ggaauggagcaaaagacaauu

SEQ ID NO: 3906 - RNA, 21 nt, Artificial Sequence
  Description of Artificial Sequence: Synthetic oligonucleotide
  Description of Combined DNA/RNA Molecule: Synthetic oligonucleotide
gaauggagcaaaagacaauua

SEQ ID NO: 3907 - RNA, 21 nt, Artificial Sequence
  Description of Artificial Sequence: Synthetic oligonucleotide
  Description of Combined DNA/RNA Molecule: Synthetic oligonucleotide
aauggagcaaaagacaauuau

SEQ ID NO: 3908 - RNA, 21 nt, Artificial Sequence
  Description of Artificial Sequence: Synthetic oligonucleotide
  Description of Combined DNA/RNA Molecule: Synthetic oligonucleotide
auggagcaaaagacaauuauu

SEQ ID NO: 3909 - RNA, 21 nt, Artificial Sequence
  Description of Artificial Sequence: Synthetic oligonucleotide
  Description of Combined DNA/RNA Molecule: Synthetic oligonucleotide
acaauuauuuuaauacccucu

SEQ ID NO: 3910 - RNA, 21 nt, Artificial Sequence
  Description of Artificial Sequence: Synthetic oligonucleotide
  Description of Combined DNA/RNA Molecule: Synthetic oligonucleotide
caauuauuuuaauacccucug

SEQ ID NO: 3911 - RNA, 21 nt, Artificial Sequence
  Description of Artificial Sequence: Synthetic oligonucleotide
  Description of Combined DNA/RNA Molecule: Synthetic oligonucleotide
aauuauuuuaauacccucuga

SEQ ID NO: 3912 - RNA, 21 nt, Artificial Sequence
  Description of Artificial Sequence: Synthetic oligonucleotide
  Description of Combined DNA/RNA Molecule: Synthetic oligonucleotide
uuauuuuaauacccucugauu

SEQ ID NO: 3913 - RNA, 21 nt, Artificial Sequence
  Description of Artificial Sequence: Synthetic oligonucleotide
  Description of Combined DNA/RNA Molecule: Synthetic oligonucleotide
uauuuuaauacccucugauuu

SEQ ID NO: 3914 - RNA, 21 nt, Artificial Sequence
  Description of Artificial Sequence: Synthetic oligonucleotide
  Description of Combined DNA/RNA Molecule: Synthetic oligonucleotide
gcuggggcaaucaauggauga

SEQ ID NO: 3915 - RNA, 21 nt, Artificial Sequence
  Description of Artificial Sequence: Synthetic oligonucleotide
  Description of Combined DNA/RNA Molecule: Synthetic oligonucleotide
ggcaaucaauggaugaaagug

SEQ ID NO: 3916 - RNA, 21 nt, Artificial Sequence
  Description of Artificial Sequence: Synthetic oligonucleotide
  Description of Combined DNA/RNA Molecule: Synthetic oligonucleotide
ccaguuaugauugugaaguua

SEQ ID NO: 3917 - RNA, 21 nt, Artificial Sequence
  Description of Artificial Sequence: Synthetic oligonucleotide
  Description of Combined DNA/RNA Molecule: Synthetic oligonucleotide
caguuaugauugugaaguuaa

SEQ ID NO: 3918 - RNA, 21 nt, Artificial Sequence
  Description of Artificial Sequence: Synthetic oligonucleotide
  Description of Combined DNA/RNA Molecule: Synthetic oligonucleotide
auugugaaguuaaugcuccua

SEQ ID NO: 3919 - RNA, 21 nt, Artificial Sequence
  Description of Artificial Sequence: Synthetic oligonucleotide
  Description of Combined DNA/RNA Molecule: Synthetic oligonucleotide
ugaaguuaaugcuccuauaca

SEQ ID NO: 3920 - RNA, 21 nt, Artificial Sequence
  Description of Artificial Sequence: Synthetic oligonucleotide
  Description of Combined DNA/RNA Molecule: Synthetic oligonucleotide
gcagggugaagaauuacucag

SEQ ID NO: 3921 - RNA, 21 nt, Artificial Sequence
  Description of Artificial Sequence: Synthetic oligonucleotide
  Description of Combined DNA/RNA Molecule: Synthetic oligonucleotide
ugaagaauuacucagagcuuu

SEQ ID NO: 3922 - RNA, 21 nt, Artificial Sequence
  Description of Artificial Sequence: Synthetic oligonucleotide
  Description of Combined DNA/RNA Molecule: Synthetic oligonucleotide
aagaauuacucagagcuuugg

SEQ ID NO: 3923 - RNA, 21 nt, Artificial Sequence
  Description of Artificial Sequence: Synthetic oligonucleotide
  Description of Combined DNA/RNA Molecule: Synthetic oligonucleotide
cucagagcuuuggaucaaguu

SEQ ID NO: 3924 - RNA, 21 nt, Artificial Sequence
  Description of Artificial Sequence: Synthetic oligonucleotide
  Description of Combined DNA/RNA Molecule: Synthetic oligonucleotide
caaguuaacugagcuuuuucu

SEQ ID NO: 3925 - RNA, 21 nt, Artificial Sequence
  Description of Artificial Sequence: Synthetic oligonucleotide
  Description of Combined DNA/RNA Molecule: Synthetic oligonucleotide
aguuaacugagcuuuuucuua

SEQ ID NO: 3926 - RNA, 21 nt, Artificial Sequence
  Description of Artificial Sequence: Synthetic oligonucleotide
  Description of Combined DNA/RNA Molecule: Synthetic oligonucleotide
cuuuuucuuaauuucauuccu

SEQ ID NO: 3927 - RNA, 21 nt, Artificial Sequence
  Description of Artificial Sequence: Synthetic oligonucleotide
  Description of Combined DNA/RNA Molecule: Synthetic oligonucleotide
ucuuaauuucauuccuuuuuu

SEQ ID NO: 3928 - RNA, 21 nt, Artificial Sequence
  Description of Artificial Sequence: Synthetic oligonucleotide
  Description of Combined DNA/RNA Molecule: Synthetic oligonucleotide
uuaauuucauuccuuuuuuug

SEQ ID NO: 3929 - RNA, 21 nt, Artificial Sequence
  Description of Artificial Sequence: Synthetic oligonucleotide
  Description of Combined DNA/RNA Molecule: Synthetic oligonucleotide
cacugguggcucauuaccuaa

SEQ ID NO: 3930 - RNA, 21 nt, Artificial Sequence
  Description of Artificial Sequence: Synthetic oligonucleotide
  Description of Combined DNA/RNA Molecule: Synthetic oligonucleotide
cucauuaccuaaagcagucua

SEQ ID NO: 3931 - RNA, 21 nt, Artificial Sequence
  Description of Artificial Sequence: Synthetic oligonucleotide
  Description of Combined DNA/RNA Molecule: Synthetic oligonucleotide
ucauuaccuaaagcagucuau

SEQ ID NO: 3932 - RNA, 21 nt, Artificial Sequence
  Description of Artificial Sequence: Synthetic oligonucleotide
  Description of Combined DNA/RNA Molecule: Synthetic oligonucleotide
accuaaagcagucuauuuaua

SEQ ID NO: 3933 - RNA, 21 nt, Artificial Sequence
  Description of Artificial Sequence: Synthetic oligonucleotide
  Description of Combined DNA/RNA Molecule: Synthetic oligonucleotide
cuaaagcagucuauuuauauu

SEQ ID NO: 3934 - RNA, 21 nt, Artificial Sequence
  Description of Artificial Sequence: Synthetic oligonucleotide
  Description of Combined DNA/RNA Molecule: Synthetic oligonucleotide
uauuuauauuuucuacaucua

SEQ ID NO: 3935 - RNA, 21 nt, Artificial Sequence
  Description of Artificial Sequence: Synthetic oligonucleotide
  Description of Combined DNA/RNA Molecule: Synthetic oligonucleotide
auuuauauuuucuacaucuaa

SEQ ID NO: 3936 - RNA, 21 nt, Artificial Sequence
  Description of Artificial Sequence: Synthetic oligonucleotide
  Description of Combined DNA/RNA Molecule: Synthetic oligonucleotide
uuuauauuuucuacaucuaau

SEQ ID NO: 3937 - RNA, 21 nt, Artificial Sequence
  Description of Artificial Sequence: Synthetic oligonucleotide
  Description of Combined DNA/RNA Molecule: Synthetic oligonucleotide
uauauuuucuacaucuaauuu

SEQ ID NO: 3938 - RNA, 21 nt, Artificial Sequence
  Description of Artificial Sequence: Synthetic oligonucleotide
  Description of Combined DNA/RNA Molecule: Synthetic oligonucleotide
auauuuucuacaucuaauuuu

SEQ ID NO: 3939 - RNA, 21 nt, Artificial Sequence
  Description of Artificial Sequence: Synthetic oligonucleotide
  Description of Combined DNA/RNA Molecule: Synthetic oligonucleotide
gccuggcuacaauacugcaca

SEQ ID NO: 3940 - RNA, 21 nt, Artificial Sequence
  Description of Artificial Sequence: Synthetic oligonucleotide
  Description of Combined DNA/RNA Molecule: Synthetic oligonucleotide
aacuugguuaguucaauuuug

SEQ ID NO: 3941 - RNA, 21 nt, Artificial Sequence
  Description of Artificial Sequence: Synthetic oligonucleotide
  Description of Combined DNA/RNA Molecule: Synthetic oligonucleotide
uuaguucaauuuugauccccu

SEQ ID NO: 3942 - RNA, 21 nt, Artificial Sequence
  Description of Artificial Sequence: Synthetic oligonucleotide
  Description of Combined DNA/RNA Molecule: Synthetic oligonucleotide
auuuugauccccuuucuacuu

SEQ ID NO: 3943 - RNA, 21 nt, Artificial Sequence
  Description of Artificial Sequence: Synthetic oligonucleotide
  Description of Combined DNA/RNA Molecule: Synthetic oligonucleotide
uuuugauccccuuucuacuua

SEQ ID NO: 3944 - RNA, 21 nt, Artificial Sequence
  Description of Artificial Sequence: Synthetic oligonucleotide
  Description of Combined DNA/RNA Molecule: Synthetic oligonucleotide
uuugauccccuuucuacuuaa

SEQ ID NO: 3945 - RNA, 21 nt, Artificial Sequence
  Description of Artificial Sequence: Synthetic oligonucleotide
  Description of Combined DNA/RNA Molecule: Synthetic oligonucleotide
cccuuucuacuuaauuuacau

SEQ ID NO: 3946 - RNA, 21 nt, Artificial Sequence
  Description of Artificial Sequence: Synthetic oligonucleotide
  Description of Combined DNA/RNA Molecule: Synthetic oligonucleotide
uuaauuuacauuaaugcucuu

SEQ ID NO: 3947 - RNA, 21 nt, Artificial Sequence
  Description of Artificial Sequence: Synthetic oligonucleotide
  Description of Combined DNA/RNA Molecule: Synthetic oligonucleotide
uaauuuacauuaaugcucuuu

SEQ ID NO: 3948 - RNA, 21 nt, Artificial Sequence
  Description of Artificial Sequence: Synthetic oligonucleotide
  Description of Combined DNA/RNA Molecule: Synthetic oligonucleotide
acauuaaugcucuuuuuuagu

SEQ ID NO: 3949 - RNA, 21 nt, Artificial Sequence
  Description of Artificial Sequence: Synthetic oligonucleotide
  Description of Combined DNA/RNA Molecule: Synthetic oligonucleotide
cauuaaugcucuuuuuuagua

SEQ ID NO: 3950 - RNA, 21 nt, Artificial Sequence
  Description of Artificial Sequence: Synthetic oligonucleotide
  Description of Combined DNA/RNA Molecule: Synthetic oligonucleotide
uuaaugcucuuuuuuaguaug

SEQ ID NO: 3951 - RNA, 21 nt, Artificial Sequence
  Description of Artificial Sequence: Synthetic oligonucleotide
  Description of Combined DNA/RNA Molecule: Synthetic oligonucleotide
cuuuuuuaguauguucuuuaa

SEQ ID NO: 3952 - RNA, 21 nt, Artificial Sequence
  Description of Artificial Sequence: Synthetic oligonucleotide
  Description of Combined DNA/RNA Molecule: Synthetic oligonucleotide
uuuaguauguucuuuaaugcu

SEQ ID NO: 3953 - RNA, 21 nt, Artificial Sequence
  Description of Artificial Sequence: Synthetic oligonucleotide
  Description of Combined DNA/RNA Molecule: Synthetic oligonucleotide
uuaguauguucuuuaaugcug

SEQ ID NO: 3954 - RNA, 21 nt, Artificial Sequence
  Description of Artificial Sequence: Synthetic oligonucleotide
  Description of Combined DNA/RNA Molecule: Synthetic oligonucleotide
uaguauguucuuuaaugcugg

SEQ ID NO: 3955 - RNA, 21 nt, Artificial Sequence
  Description of Artificial Sequence: Synthetic oligonucleotide
  Description of Combined DNA/RNA Molecule: Synthetic oligonucleotide
cacagacagcucauuuucuca

SEQ ID NO: 3956 - RNA, 21 nt, Artificial Sequence
  Description of Artificial Sequence: Synthetic oligonucleotide
  Description of Combined DNA/RNA Molecule: Synthetic oligonucleotide
cucauuuucucaguuuuuugg

SEQ ID NO: 3957 - RNA, 21 nt, Artificial Sequence
  Description of Artificial Sequence: Synthetic oligonucleotide
  Description of Combined DNA/RNA Molecule: Synthetic oligonucleotide
ucauuuucucaguuuuuuggu

SEQ ID NO: 3958 - RNA, 21 nt, Artificial Sequence
  Description of Artificial Sequence: Synthetic oligonucleotide
  Description of Combined DNA/RNA Molecule: Synthetic oligonucleotide
cauuuucucaguuuuuuggua

SEQ ID NO: 3959 - RNA, 21 nt, Artificial Sequence
  Description of Artificial Sequence: Synthetic oligonucleotide
  Description of Combined DNA/RNA Molecule: Synthetic oligonucleotide
guuuuuugguauuuaaaccau

SEQ ID NO: 3960 - RNA, 21 nt, Artificial Sequence
  Description of Artificial Sequence: Synthetic oligonucleotide
  Description of Combined DNA/RNA Molecule: Synthetic oligonucleotide
uuugguauuuaaaccauugca

SEQ ID NO: 3961 - RNA, 21 nt, Artificial Sequence
  Description of Artificial Sequence: Synthetic oligonucleotide
  Description of Combined DNA/RNA Molecule: Synthetic oligonucleotide
uugguauuuaaaccauugcau

SEQ ID NO: 3962 - RNA, 21 nt, Artificial Sequence
  Description of Artificial Sequence: Synthetic oligonucleotide
  Description of Combined DNA/RNA Molecule: Synthetic oligonucleotide
auuuaaaccauugcauugcag

SEQ ID NO: 3963 - RNA, 21 nt, Artificial Sequence
  Description of Artificial Sequence: Synthetic oligonucleotide
  Description of Combined DNA/RNA Molecule: Synthetic oligonucleotide
gcauugcaguagcaucauuuu

SEQ ID NO: 3964 - RNA, 21 nt, Artificial Sequence
  Description of Artificial Sequence: Synthetic oligonucleotide
  Description of Combined DNA/RNA Molecule: Synthetic oligonucleotide
gcaguagcaucauuuuaaaaa

SEQ ID NO: 3965 - RNA, 21 nt, Artificial Sequence
  Description of Artificial Sequence: Synthetic oligonucleotide
  Description of Combined DNA/RNA Molecule: Synthetic oligonucleotide
caguagcaucauuuuaaaaaa

SEQ ID NO: 3966 - RNA, 21 nt, Artificial Sequence
  Description of Artificial Sequence: Synthetic oligonucleotide
  Description of Combined DNA/RNA Molecule: Synthetic oligonucleotide
aucauuuuaaaaaaugcaccu

SEQ ID NO: 3967 - RNA, 21 nt, Artificial Sequence
  Description of Artificial Sequence: Synthetic oligonucleotide
  Description of Combined DNA/RNA Molecule: Synthetic oligonucleotide
ucauuuuaaaaaaugcaccuu

SEQ ID NO: 3968 - RNA, 21 nt, Artificial Sequence
  Description of Artificial Sequence: Synthetic oligonucleotide
  Description of Combined DNA/RNA Molecule: Synthetic oligonucleotide
cauuuuaaaaaaugcaccuuu

SEQ ID NO: 3969 - RNA, 21 nt, Artificial Sequence
  Description of Artificial Sequence: Synthetic oligonucleotide
  Description of Combined DNA/RNA Molecule: Synthetic oligonucleotide
auuuuaaaaaaugcaccuuuu

SEQ ID NO: 3970 - RNA, 21 nt, Artificial Sequence
  Description of Artificial Sequence: Synthetic oligonucleotide
  Description of Combined DNA/RNA Molecule: Synthetic oligonucleotide
uuuuaaaaaaugcaccuuuuu

SEQ ID NO: 3971 - RNA, 21 nt, Artificial Sequence
  Description of Artificial Sequence: Synthetic oligonucleotide
  Description of Combined DNA/RNA Molecule: Synthetic oligonucleotide
uuuaaaaaaugcaccuuuuua

SEQ ID NO: 3972 - RNA, 21 nt, Artificial Sequence
  Description of Artificial Sequence: Synthetic oligonucleotide
  Description of Combined DNA/RNA Molecule: Synthetic oligonucleotide
uaaaaaaugcaccuuuuuauu

SEQ ID NO: 3973 - RNA, 21 nt, Artificial Sequence
  Description of Artificial Sequence: Synthetic oligonucleotide
  Description of Combined DNA/RNA Molecule: Synthetic oligonucleotide
aaaaaugcaccuuuuuauuua

SEQ ID NO: 3974 - RNA, 21 nt, Artificial Sequence
  Description of Artificial Sequence: Synthetic oligonucleotide
  Description of Combined DNA/RNA Molecule: Synthetic oligonucleotide
accuuuuuauuuauuuauuuu

SEQ ID NO: 3975 - RNA, 21 nt, Artificial Sequence
  Description of Artificial Sequence: Synthetic oligonucleotide
  Description of Combined DNA/RNA Molecule: Synthetic oligonucleotide
uuauuuauuuauuuuuggcua

SEQ ID NO: 3976 - RNA, 21 nt, Artificial Sequence
  Description of Artificial Sequence: Synthetic oligonucleotide
  Description of Combined DNA/RNA Molecule: Synthetic oligonucleotide
auuuauuuauuuuuggcuagg

SEQ ID NO: 3977 - RNA, 21 nt, Artificial Sequence
  Description of Artificial Sequence: Synthetic oligonucleotide
  Description of Combined DNA/RNA Molecule: Synthetic oligonucleotide
uuuauuuauuuuuggcuaggg

SEQ ID NO: 3978 - RNA, 21 nt, Artificial Sequence
  Description of Artificial Sequence: Synthetic oligonucleotide
  Description of Combined DNA/RNA Molecule: Synthetic oligonucleotide
uuauuuauuuuuggcuaggga

SEQ ID NO: 3979 - RNA, 21 nt, Artificial Sequence
  Description of Artificial Sequence: Synthetic oligonucleotide
  Description of Combined DNA/RNA Molecule: Synthetic oligonucleotide
uauuuauuuuuggcuagggag

SEQ ID NO: 3980 - RNA, 21 nt, Artificial Sequence
  Description of Artificial Sequence: Synthetic oligonucleotide
  Description of Combined DNA/RNA Molecule: Synthetic oligonucleotide
agggaguuuaucccuuuuucg

SEQ ID NO: 3981 - RNA, 21 nt, Artificial Sequence
  Description of Artificial Sequence: Synthetic oligonucleotide
  Description of Combined DNA/RNA Molecule: Synthetic oligonucleotide
gggaguuuaucccuuuuucga

SEQ ID NO: 3982 - RNA, 21 nt, Artificial Sequence
  Description of Artificial Sequence: Synthetic oligonucleotide
  Description of Combined DNA/RNA Molecule: Synthetic oligonucleotide
ggaguuuaucccuuuuucgaa

SEQ ID NO: 3983 - RNA, 21 nt, Artificial Sequence
  Description of Artificial Sequence: Synthetic oligonucleotide
  Description of Combined DNA/RNA Molecule: Synthetic oligonucleotide
gaguuuaucccuuuuucgaau

SEQ ID NO: 3984 - RNA, 21 nt, Artificial Sequence
  Description of Artificial Sequence: Synthetic oligonucleotide
  Description of Combined DNA/RNA Molecule: Synthetic oligonucleotide
aguuuaucccuuuuucgaauu

SEQ ID NO: 3985 - RNA, 21 nt, Artificial Sequence
  Description of Artificial Sequence: Synthetic oligonucleotide
  Description of Combined DNA/RNA Molecule: Synthetic oligonucleotide
guuuaucccuuuuucgaauua

SEQ ID NO: 3986 - RNA, 21 nt, Artificial Sequence
  Description of Artificial Sequence: Synthetic oligonucleotide
  Description of Combined DNA/RNA Molecule: Synthetic oligonucleotide
uucgaauuauuuuuaagaaga

SEQ ID NO: 3987 - RNA, 21 nt, Artificial Sequence
  Description of Artificial Sequence: Synthetic oligonucleotide
  Description of Combined DNA/RNA Molecule: Synthetic oligonucleotide
auuauuuuuaagaagaugcca

SEQ ID NO: 3988 - RNA, 21 nt, Artificial Sequence
  Description of Artificial Sequence: Synthetic oligonucleotide
  Description of Combined DNA/RNA Molecule: Synthetic oligonucleotide
uuauuuuuaagaagaugccaa

SEQ ID NO: 3989 - RNA, 21 nt, Artificial Sequence
  Description of Artificial Sequence: Synthetic oligonucleotide
  Description of Combined DNA/RNA Molecule: Synthetic oligonucleotide
auuuuuaagaagaugccaaua

SEQ ID NO: 3990 - RNA, 21 nt, Artificial Sequence
  Description of Artificial Sequence: Synthetic oligonucleotide
  Description of Combined DNA/RNA Molecule: Synthetic oligonucleotide
uuuuuaagaagaugccaauau

SEQ ID NO: 3991 - RNA, 21 nt, Artificial Sequence
  Description of Artificial Sequence: Synthetic oligonucleotide
  Description of Combined DNA/RNA Molecule: Synthetic oligonucleotide
uuuaagaagaugccaauauaa

SEQ ID NO: 3992 - RNA, 21 nt, Artificial Sequence
  Description of Artificial Sequence: Synthetic oligonucleotide
  Description of Combined DNA/RNA Molecule: Synthetic oligonucleotide
uuaagaagaugccaauauaau

SEQ ID NO: 3993 - RNA, 21 nt, Artificial Sequence
  Description of Artificial Sequence: Synthetic oligonucleotide
  Description of Combined DNA/RNA Molecule: Synthetic oligonucleotide
aagaagaugccaauauaauuu

SEQ ID NO: 3994 - RNA, 21 nt, Artificial Sequence
  Description of Artificial Sequence: Synthetic oligonucleotide
  Description of Combined DNA/RNA Molecule: Synthetic oligonucleotide
agaagaugccaauauaauuuu

SEQ ID NO: 3995 - RNA, 21 nt, Artificial Sequence
  Description of Artificial Sequence: Synthetic oligonucleotide
  Description of Combined DNA/RNA Molecule: Synthetic oligonucleotide
gaagaugccaauauaauuuuu

SEQ ID NO: 3996 - RNA, 21 nt, Artificial Sequence
  Description of Artificial Sequence: Synthetic oligonucleotide
  Description of Combined DNA/RNA Molecule: Synthetic oligonucleotide
ccaauauaauuuuuguaagaa

SEQ ID NO: 3997 - RNA, 21 nt, Artificial Sequence
  Description of Artificial Sequence: Synthetic oligonucleotide
  Description of Combined DNA/RNA Molecule: Synthetic oligonucleotide
uauaauuuuuguaagaaggca

SEQ ID NO: 3998 - RNA, 21 nt, Artificial Sequence
  Description of Artificial Sequence: Synthetic oligonucleotide
  Description of Combined DNA/RNA Molecule: Synthetic oligonucleotide
uaauuuuuguaagaaggcagu

SEQ ID NO: 3999 - RNA, 21 nt, Artificial Sequence
  Description of Artificial Sequence: Synthetic oligonucleotide
  Description of Combined DNA/RNA Molecule: Synthetic oligonucleotide
aucaugaucauaggcaguuga

SEQ ID NO: 4000 - RNA, 21 nt, Artificial Sequence
  Description of Artificial Sequence: Synthetic oligonucleotide
  Description of Combined DNA/RNA Molecule: Synthetic oligonucleotide
caugaucauaggcaguugaaa

SEQ ID NO: 4001 - RNA, 21 nt, Artificial Sequence
  Description of Artificial Sequence: Synthetic oligonucleotide
  Description of Combined DNA/RNA Molecule: Synthetic oligonucleotide
aucauaggcaguugaaaaauu

SEQ ID NO: 4002 - RNA, 21 nt, Artificial Sequence
  Description of Artificial Sequence: Synthetic oligonucleotide
  Description of Combined DNA/RNA Molecule: Synthetic oligonucleotide
cauaggcaguugaaaaauuuu

SEQ ID NO: 4003 - RNA, 21 nt, Artificial Sequence
  Description of Artificial Sequence: Synthetic oligonucleotide
  Description of Combined DNA/RNA Molecule: Synthetic oligonucleotide
guugaaaaauuuuuacaccuu

SEQ ID NO: 4004 - RNA, 21 nt, Artificial Sequence
  Description of Artificial Sequence: Synthetic oligonucleotide
  Description of Combined DNA/RNA Molecule: Synthetic oligonucleotide
uugaaaaauuuuuacaccuuu

SEQ ID NO: 4005 - RNA, 21 nt, Artificial Sequence
  Description of Artificial Sequence: Synthetic oligonucleotide
  Description of Combined DNA/RNA Molecule: Synthetic oligonucleotide
ugaaaaauuuuuacaccuuuu

SEQ ID NO: 4006 - RNA, 21 nt, Artificial Sequence
  Description of Artificial Sequence: Synthetic oligonucleotide
  Description of Combined DNA/RNA Molecule: Synthetic oligonucleotide
gaaaaauuuuuacaccuuuuu

SEQ ID NO: 4007 - RNA, 21 nt, Artificial Sequence
  Description of Artificial Sequence: Synthetic oligonucleotide
  Description of Combined DNA/RNA Molecule: Synthetic oligonucleotide
aaaaauuuuuacaccuuuuuu

SEQ ID NO: 4008 - RNA, 21 nt, Artificial Sequence
  Description of Artificial Sequence: Synthetic oligonucleotide
  Description of Combined DNA/RNA Molecule: Synthetic oligonucleotide
cuuuuuuuucacauuuuacau

SEQ ID NO: 4009 - RNA, 21 nt, Artificial Sequence
  Description of Artificial Sequence: Synthetic oligonucleotide
  Description of Combined DNA/RNA Molecule: Synthetic oligonucleotide
uuuuuuuucacauuuuacaua

SEQ ID NO: 4010 - RNA, 21 nt, Artificial Sequence
  Description of Artificial Sequence: Synthetic oligonucleotide
  Description of Combined DNA/RNA Molecule: Synthetic oligonucleotide
uuuuuuucacauuuuacauaa

SEQ ID NO: 4011 - RNA, 21 nt, Artificial Sequence
  Description of Artificial Sequence: Synthetic oligonucleotide
  Description of Combined DNA/RNA Molecule: Synthetic oligonucleotide
uuuuuucacauuuuacauaaa

SEQ ID NO: 4012 - RNA, 21 nt, Artificial Sequence
  Description of Artificial Sequence: Synthetic oligonucleotide
  Description of Combined DNA/RNA Molecule: Synthetic oligonucleotide
cacauuuuacauaaauaauaa

SEQ ID NO: 4013 - RNA, 21 nt, Artificial Sequence
  Description of Artificial Sequence: Synthetic oligonucleotide
  Description of Combined DNA/RNA Molecule: Synthetic oligonucleotide
ugguagccacaauugcacaau

SEQ ID NO: 4014 - RNA, 21 nt, Artificial Sequence
  Description of Artificial Sequence: Synthetic oligonucleotide
  Description of Combined DNA/RNA Molecule: Synthetic oligonucleotide
acaauauauuuucuuaaaaaa

SEQ ID NO: 4015 - RNA, 21 nt, Artificial Sequence
  Description of Artificial Sequence: Synthetic oligonucleotide
  Description of Combined DNA/RNA Molecule: Synthetic oligonucleotide
uucuuaaaaaauaccagcagu

SEQ ID NO: 4016 - RNA, 21 nt, Artificial Sequence
  Description of Artificial Sequence: Synthetic oligonucleotide
  Description of Combined DNA/RNA Molecule: Synthetic oligonucleotide
agcaguuacucauggaauaua

SEQ ID NO: 4017 - RNA, 21 nt, Artificial Sequence
  Description of Artificial Sequence: Synthetic oligonucleotide
  Description of Combined DNA/RNA Molecule: Synthetic oligonucleotide
cucauggaauauauucugcgu

SEQ ID NO: 4018 - RNA, 21 nt, Artificial Sequence
  Description of Artificial Sequence: Synthetic oligonucleotide
  Description of Combined DNA/RNA Molecule: Synthetic oligonucleotide
ucauggaauauauucugcguu

SEQ ID NO: 4019 - RNA, 21 nt, Artificial Sequence
  Description of Artificial Sequence: Synthetic oligonucleotide
  Description of Combined DNA/RNA Molecule: Synthetic oligonucleotide
cauggaauauauucugcguuu

SEQ ID NO: 4020 - RNA, 21 nt, Artificial Sequence
  Description of Artificial Sequence: Synthetic oligonucleotide
  Description of Combined DNA/RNA Molecule: Synthetic oligonucleotide
auggaauauauucugcguuua

SEQ ID NO: 4021 - RNA, 21 nt, Artificial Sequence
  Description of Artificial Sequence: Synthetic oligonucleotide
  Description of Combined DNA/RNA Molecule: Synthetic oligonucleotide
uggaauauauucugcguuuau

SEQ ID NO: 4022 - RNA, 21 nt, Artificial Sequence
  Description of Artificial Sequence: Synthetic oligonucleotide
  Description of Combined DNA/RNA Molecule: Synthetic oligonucleotide
ggaauauauucugcguuuaua

SEQ ID NO: 4023 - RNA, 21 nt, Artificial Sequence
  Description of Artificial Sequence: Synthetic oligonucleotide
  Description of Combined DNA/RNA Molecule: Synthetic oligonucleotide
gaauauauucugcguuuauaa

SEQ ID NO: 4024 - RNA, 21 nt, Artificial Sequence
  Description of Artificial Sequence: Synthetic oligonucleotide
  Description of Combined DNA/RNA Molecule: Synthetic oligonucleotide
uuauaaaacuaguuuuuaaga

SEQ ID NO: 4025 - RNA, 21 nt, Artificial Sequence
  Description of Artificial Sequence: Synthetic oligonucleotide
  Description of Combined DNA/RNA Molecule: Synthetic oligonucleotide
aacuaguuuuuaagaagaaau

SEQ ID NO: 4026 - RNA, 21 nt, Artificial Sequence
  Description of Artificial Sequence: Synthetic oligonucleotide
  Description of Combined DNA/RNA Molecule: Synthetic oligonucleotide
acuaguuuuuaagaagaaauu

SEQ ID NO: 4027 - RNA, 21 nt, Artificial Sequence
  Description of Artificial Sequence: Synthetic oligonucleotide
  Description of Combined DNA/RNA Molecule: Synthetic oligonucleotide
cuaguuuuuaagaagaaauuu

SEQ ID NO: 4028 - RNA, 21 nt, Artificial Sequence
  Description of Artificial Sequence: Synthetic oligonucleotide
  Description of Combined DNA/RNA Molecule: Synthetic oligonucleotide
uaguuuuuaagaagaaauuuu

SEQ ID NO: 4029 - RNA, 21 nt, Artificial Sequence
  Description of Artificial Sequence: Synthetic oligonucleotide
  Description of Combined DNA/RNA Molecule: Synthetic oligonucleotide
uuuuuaagaagaaauuuuuuu

SEQ ID NO: 4030 - RNA, 21 nt, Artificial Sequence
  Description of Artificial Sequence: Synthetic oligonucleotide
  Description of Combined DNA/RNA Molecule: Synthetic oligonucleotide
agaagaaauuuuuuuuggccu

SEQ ID NO: 4031 - RNA, 21 nt, Artificial Sequence
  Description of Artificial Sequence: Synthetic oligonucleotide
  Description of Combined DNA/RNA Molecule: Synthetic oligonucleotide
aagaaauuuuuuuuggccuau

SEQ ID NO: 4032 - RNA, 21 nt, Artificial Sequence
  Description of Artificial Sequence: Synthetic oligonucleotide
  Description of Combined DNA/RNA Molecule: Synthetic oligonucleotide
gaaauuuuuuuuggccuauga

SEQ ID NO: 4033 - RNA, 21 nt, Artificial Sequence
  Description of Artificial Sequence: Synthetic oligonucleotide
  Description of Combined DNA/RNA Molecule: Synthetic oligonucleotide
aauuuuuuuuggccuaugaaa

SEQ ID NO: 4034 - RNA, 21 nt, Artificial Sequence
  Description of Artificial Sequence: Synthetic oligonucleotide
  Description of Combined DNA/RNA Molecule: Synthetic oligonucleotide
uuuuuuuggccuaugaaauug

SEQ ID NO: 4035 - RNA, 21 nt, Artificial Sequence
  Description of Artificial Sequence: Synthetic oligonucleotide
  Description of Combined DNA/RNA Molecule: Synthetic oligonucleotide
uuuuuuggccuaugaaauugu

SEQ ID NO: 4036 - RNA, 21 nt, Artificial Sequence
  Description of Artificial Sequence: Synthetic oligonucleotide
  Description of Combined DNA/RNA Molecule: Synthetic oligonucleotide
uuuuuggccuaugaaauuguu

SEQ ID NO: 4037 - RNA, 21 nt, Artificial Sequence
  Description of Artificial Sequence: Synthetic oligonucleotide
  Description of Combined DNA/RNA Molecule: Synthetic oligonucleotide
uuuuggccuaugaaauuguua

SEQ ID NO: 4038 - RNA, 21 nt, Artificial Sequence
  Description of Artificial Sequence: Synthetic oligonucleotide
  Description of Combined DNA/RNA Molecule: Synthetic oligonucleotide
gccuaugaaauuguuaaaccu

SEQ ID NO: 4039 - RNA, 21 nt, Artificial Sequence
  Description of Artificial Sequence: Synthetic oligonucleotide
  Description of Combined DNA/RNA Molecule: Synthetic oligonucleotide
cuaugaaauuguuaaaccugg

SEQ ID NO: 4040 - RNA, 21 nt, Artificial Sequence
  Description of Artificial Sequence: Synthetic oligonucleotide
  Description of Combined DNA/RNA Molecule: Synthetic oligonucleotide
gaaauuguuaaaccuggaaca

SEQ ID NO: 4041 - RNA, 21 nt, Artificial Sequence
  Description of Artificial Sequence: Synthetic oligonucleotide
  Description of Combined DNA/RNA Molecule: Synthetic oligonucleotide
aaauuguuaaaccuggaacau

SEQ ID NO: 4042 - RNA, 21 nt, Artificial Sequence
  Description of Artificial Sequence: Synthetic oligonucleotide
  Description of Combined DNA/RNA Molecule: Synthetic oligonucleotide
accuggaacaugacauuguua

SEQ ID NO: 4043 - RNA, 21 nt, Artificial Sequence
  Description of Artificial Sequence: Synthetic oligonucleotide
  Description of Combined DNA/RNA Molecule: Synthetic oligonucleotide
aacaugacauuguuaaucaua

SEQ ID NO: 4044 - RNA, 21 nt, Artificial Sequence
  Description of Artificial Sequence: Synthetic oligonucleotide
  Description of Combined DNA/RNA Molecule: Synthetic oligonucleotide
acaugacauuguuaaucauau

SEQ ID NO: 4045 - RNA, 21 nt, Artificial Sequence
  Description of Artificial Sequence: Synthetic oligonucleotide
  Description of Combined DNA/RNA Molecule: Synthetic oligonucleotide
gacauuguuaaucauauaaua

SEQ ID NO: 4046 - RNA, 21 nt, Artificial Sequence
  Description of Artificial Sequence: Synthetic oligonucleotide
  Description of Combined DNA/RNA Molecule: Synthetic oligonucleotide
cauuguuaaucauauaauaau

SEQ ID NO: 4047 - RNA, 21 nt, Artificial Sequence
  Description of Artificial Sequence: Synthetic oligonucleotide
  Description of Combined DNA/RNA Molecule: Synthetic oligonucleotide
auuguuaaucauauaauaaug

SEQ ID NO: 4048 - RNA, 21 nt, Artificial Sequence
  Description of Artificial Sequence: Synthetic oligonucleotide
  Description of Combined DNA/RNA Molecule: Synthetic oligonucleotide
uuguuaaucauauaauaauga

SEQ ID NO: 4049 - RNA, 21 nt, Artificial Sequence
  Description of Artificial Sequence: Synthetic oligonucleotide
  Description of Combined DNA/RNA Molecule: Synthetic oligonucleotide
ucauauaauaaugauucuuaa

SEQ ID NO: 4050 - RNA, 21 nt, Artificial Sequence
  Description of Artificial Sequence: Synthetic oligonucleotide
  Description of Combined DNA/RNA Molecule: Synthetic oligonucleotide
cauauaauaaugauucuuaaa

SEQ ID NO: 4051 - RNA, 21 nt, Artificial Sequence
  Description of Artificial Sequence: Synthetic oligonucleotide
  Description of Combined DNA/RNA Molecule: Synthetic oligonucleotide
uaauaaugauucuuaaaugcu

SEQ ID NO: 4052 - RNA, 21 nt, Artificial Sequence
  Description of Artificial Sequence: Synthetic oligonucleotide
  Description of Combined DNA/RNA Molecule: Synthetic oligonucleotide
uaaugauucuuaaaugcugua

SEQ ID NO: 4053 - RNA, 21 nt, Artificial Sequence
  Description of Artificial Sequence: Synthetic oligonucleotide
  Description of Combined DNA/RNA Molecule: Synthetic oligonucleotide
aaugauucuuaaaugcuguau

SEQ ID NO: 4054 - RNA, 21 nt, Artificial Sequence
  Description of Artificial Sequence: Synthetic oligonucleotide
  Description of Combined DNA/RNA Molecule: Synthetic oligonucleotide
augauucuuaaaugcuguaug

SEQ ID NO: 4055 - RNA, 21 nt, Artificial Sequence
  Description of Artificial Sequence: Synthetic oligonucleotide
  Description of Combined DNA/RNA Molecule: Synthetic oligonucleotide
ucuuaaaugcuguaugguuua

SEQ ID NO: 4056 - RNA, 21 nt, Artificial Sequence
  Description of Artificial Sequence: Synthetic oligonucleotide
  Description of Combined DNA/RNA Molecule: Synthetic oligonucleotide
cuuaaaugcuguaugguuuau

SEQ ID NO: 4057 - RNA, 21 nt, Artificial Sequence
  Description of Artificial Sequence: Synthetic oligonucleotide
  Description of Combined DNA/RNA Molecule: Synthetic oligonucleotide
uaaaugcuguaugguuuauua

SEQ ID NO: 4058 - RNA, 21 nt, Artificial Sequence
  Description of Artificial Sequence: Synthetic oligonucleotide
  Description of Combined DNA/RNA Molecule: Synthetic oligonucleotide
uguaugguuuauuauuuaaau

SEQ ID NO: 4059 - RNA, 21 nt, Artificial Sequence
  Description of Artificial Sequence: Synthetic oligonucleotide
  Description of Combined DNA/RNA Molecule: Synthetic oligonucleotide
uaugguuuauuauuuaaaugg

SEQ ID NO: 4060 - RNA, 21 nt, Artificial Sequence
  Description of Artificial Sequence: Synthetic oligonucleotide
  Description of Combined DNA/RNA Molecule: Synthetic oligonucleotide
augguuuauuauuuaaauggg

SEQ ID NO: 4061 - RNA, 21 nt, Artificial Sequence
  Description of Artificial Sequence: Synthetic oligonucleotide
  Description of Combined DNA/RNA Molecule: Synthetic oligonucleotide
gguuuauuauuuaaaugggua

SEQ ID NO: 4062 - RNA, 21 nt, Artificial Sequence
  Description of Artificial Sequence: Synthetic oligonucleotide
  Description of Combined DNA/RNA Molecule: Synthetic oligonucleotide
guuuauuauuuaaauggguaa

SEQ ID NO: 4063 - RNA, 21 nt, Artificial Sequence
  Description of Artificial Sequence: Synthetic oligonucleotide
  Description of Combined DNA/RNA Molecule: Synthetic oligonucleotide
uuauuuaaauggguaaagcca

SEQ ID NO: 4064 - RNA, 21 nt, Artificial Sequence
  Description of Artificial Sequence: Synthetic oligonucleotide
  Description of Combined DNA/RNA Molecule: Synthetic oligonucleotide
aaauggguaaagccauuuaca

SEQ ID NO: 4065 - RNA, 21 nt, Artificial Sequence
  Description of Artificial Sequence: Synthetic oligonucleotide
  Description of Combined DNA/RNA Molecule: Synthetic oligonucleotide
uggguaaagccauuuacauaa

SEQ ID NO: 4066 - RNA, 21 nt, Artificial Sequence
  Description of Artificial Sequence: Synthetic oligonucleotide
  Description of Combined DNA/RNA Molecule: Synthetic oligonucleotide
gguaaagccauuuacauaaua

SEQ ID NO: 4067 - RNA, 21 nt, Artificial Sequence
  Description of Artificial Sequence: Synthetic oligonucleotide
  Description of Combined DNA/RNA Molecule: Synthetic oligonucleotide
guaaagccauuuacauaauau

SEQ ID NO: 4068 - RNA, 21 nt, Artificial Sequence
  Description of Artificial Sequence: Synthetic oligonucleotide
  Description of Combined DNA/RNA Molecule: Synthetic oligonucleotide
gccauuuacauaauauagaaa

SEQ ID NO: 4069 - RNA, 21 nt, Artificial Sequence
  Description of Artificial Sequence: Synthetic oligonucleotide
  Description of Combined DNA/RNA Molecule: Synthetic oligonucleotide
auaauauagaaagauaugcau

SEQ ID NO: 4070 - RNA, 21 nt, Artificial Sequence
  Description of Artificial Sequence: Synthetic oligonucleotide
  Description of Combined DNA/RNA Molecule: Synthetic oligonucleotide
uaauauagaaagauaugcaua

SEQ ID NO: 4071 - RNA, 21 nt, Artificial Sequence
  Description of Artificial Sequence: Synthetic oligonucleotide
  Description of Combined DNA/RNA Molecule: Synthetic oligonucleotide
aauauagaaagauaugcauau

SEQ ID NO: 4072 - RNA, 21 nt, Artificial Sequence
  Description of Artificial Sequence: Synthetic oligonucleotide
  Description of Combined DNA/RNA Molecule: Synthetic oligonucleotide
uagaaagauaugcauauaucu

SEQ ID NO: 4073 - RNA, 21 nt, Artificial Sequence
  Description of Artificial Sequence: Synthetic oligonucleotide
  Description of Combined DNA/RNA Molecule: Synthetic oligonucleotide
aaagauaugcauauaucuaga

SEQ ID NO: 4074 - RNA, 21 nt, Artificial Sequence
  Description of Artificial Sequence: Synthetic oligonucleotide
  Description of Combined DNA/RNA Molecule: Synthetic oligonucleotide
aagauaugcauauaucuagaa

SEQ ID NO: 4075 - RNA, 21 nt, Artificial Sequence
  Description of Artificial Sequence: Synthetic oligonucleotide
  Description of Combined DNA/RNA Molecule: Synthetic oligonucleotide
agauaugcauauaucuagaag

SEQ ID NO: 4076 - RNA, 21 nt, Artificial Sequence
  Description of Artificial Sequence: Synthetic oligonucleotide
  Description of Combined DNA/RNA Molecule: Synthetic oligonucleotide
ugcauauaucuagaagguaug

SEQ ID NO: 4077 - RNA, 21 nt, Artificial Sequence
  Description of Artificial Sequence: Synthetic oligonucleotide
  Description of Combined DNA/RNA Molecule: Synthetic oligonucleotide
gcauauaucuagaagguaugu

SEQ ID NO: 4078 - RNA, 21 nt, Artificial Sequence
  Description of Artificial Sequence: Synthetic oligonucleotide
  Description of Combined DNA/RNA Molecule: Synthetic oligonucleotide
ucuagaagguauguggcauuu

SEQ ID NO: 4079 - RNA, 21 nt, Artificial Sequence
  Description of Artificial Sequence: Synthetic oligonucleotide
  Description of Combined DNA/RNA Molecule: Synthetic oligonucleotide
gaagguauguggcauuuauuu

SEQ ID NO: 4080 - RNA, 21 nt, Artificial Sequence
  Description of Artificial Sequence: Synthetic oligonucleotide
  Description of Combined DNA/RNA Molecule: Synthetic oligonucleotide
guauguggcauuuauuuggau

SEQ ID NO: 4081 - RNA, 21 nt, Artificial Sequence
  Description of Artificial Sequence: Synthetic oligonucleotide
  Description of Combined DNA/RNA Molecule: Synthetic oligonucleotide
auguggcauuuauuuggauaa

SEQ ID NO: 4082 - RNA, 21 nt, Artificial Sequence
  Description of Artificial Sequence: Synthetic oligonucleotide
  Description of Combined DNA/RNA Molecule: Synthetic oligonucleotide
uuuauuuggauaaaauucuca

SEQ ID NO: 4083 - RNA, 21 nt, Artificial Sequence
  Description of Artificial Sequence: Synthetic oligonucleotide
  Description of Combined DNA/RNA Molecule: Synthetic oligonucleotide
uggauaaaauucucaauucag

SEQ ID NO: 4084 - RNA, 21 nt, Artificial Sequence
  Description of Artificial Sequence: Synthetic oligonucleotide
  Description of Combined DNA/RNA Molecule: Synthetic oligonucleotide
gauaaaauucucaauucagag

SEQ ID NO: 4085 - RNA, 21 nt, Artificial Sequence
  Description of Artificial Sequence: Synthetic oligonucleotide
  Description of Combined DNA/RNA Molecule: Synthetic oligonucleotide
uaaaauucucaauucagagaa

SEQ ID NO: 4086 - RNA, 21 nt, Artificial Sequence
  Description of Artificial Sequence: Synthetic oligonucleotide
  Description of Combined DNA/RNA Molecule: Synthetic oligonucleotide
ucaauucagagaaaucaucug

SEQ ID NO: 4087 - RNA, 21 nt, Artificial Sequence
  Description of Artificial Sequence: Synthetic oligonucleotide
  Description of Combined DNA/RNA Molecule: Synthetic oligonucleotide
uucagagaaaucaucugaugu

SEQ ID NO: 4088 - RNA, 21 nt, Artificial Sequence
  Description of Artificial Sequence: Synthetic oligonucleotide
  Description of Combined DNA/RNA Molecule: Synthetic oligonucleotide
agaaaucaucugauguuucua

SEQ ID NO: 4089 - RNA, 21 nt, Artificial Sequence
  Description of Artificial Sequence: Synthetic oligonucleotide
  Description of Combined DNA/RNA Molecule: Synthetic oligonucleotide
ucugauguuucuauagucacu

SEQ ID NO: 4090 - RNA, 21 nt, Artificial Sequence
  Description of Artificial Sequence: Synthetic oligonucleotide
  Description of Combined DNA/RNA Molecule: Synthetic oligonucleotide
cugauguuucuauagucacuu

SEQ ID NO: 4091 - RNA, 21 nt, Artificial Sequence
  Description of Artificial Sequence: Synthetic oligonucleotide
  Description of Combined DNA/RNA Molecule: Synthetic oligonucleotide
ucaaaagaaaacaauacccua

SEQ ID NO: 4092 - RNA, 21 nt, Artificial Sequence
  Description of Artificial Sequence: Synthetic oligonucleotide
  Description of Combined DNA/RNA Molecule: Synthetic oligonucleotide
aaaagaaaacaauacccuaug

SEQ ID NO: 4093 - RNA, 21 nt, Artificial Sequence
  Description of Artificial Sequence: Synthetic oligonucleotide
  Description of Combined DNA/RNA Molecule: Synthetic oligonucleotide
aaagaaaacaauacccuaugu

SEQ ID NO: 4094 - RNA, 21 nt, Artificial Sequence
  Description of Artificial Sequence: Synthetic oligonucleotide
  Description of Combined DNA/RNA Molecule: Synthetic oligonucleotide
agaaaacaauacccuauguag

SEQ ID NO: 4095 - RNA, 21 nt, Artificial Sequence
  Description of Artificial Sequence: Synthetic oligonucleotide
  Description of Combined DNA/RNA Molecule: Synthetic oligonucleotide
aacaauacccuauguaguugu

SEQ ID NO: 4096 - RNA, 21 nt, Artificial Sequence
  Description of Artificial Sequence: Synthetic oligonucleotide
  Description of Combined DNA/RNA Molecule: Synthetic oligonucleotide
ccuauguaguuguggaaguuu

SEQ ID NO: 4097 - RNA, 21 nt, Artificial Sequence
  Description of Artificial Sequence: Synthetic oligonucleotide
  Description of Combined DNA/RNA Molecule: Synthetic oligonucleotide
cuauguaguuguggaaguuua

SEQ ID NO: 4098 - RNA, 21 nt, Artificial Sequence
  Description of Artificial Sequence: Synthetic oligonucleotide
  Description of Combined DNA/RNA Molecule: Synthetic oligonucleotide
uaguuguggaaguuuaugcua

SEQ ID NO: 4099 - RNA, 21 nt, Artificial Sequence
  Description of Artificial Sequence: Synthetic oligonucleotide
  Description of Combined DNA/RNA Molecule: Synthetic oligonucleotide
aguuguggaaguuuaugcuaa

SEQ ID NO: 4100 - RNA, 21 nt, Artificial Sequence
  Description of Artificial Sequence: Synthetic oligonucleotide
  Description of Combined DNA/RNA Molecule: Synthetic oligonucleotide
uuguggaaguuuaugcuaaua

SEQ ID NO: 4101 - RNA, 21 nt, Artificial Sequence
  Description of Artificial Sequence: Synthetic oligonucleotide
  Description of Combined DNA/RNA Molecule: Synthetic oligonucleotide
guggaaguuuaugcuaauauu

SEQ ID NO: 4102 - RNA, 21 nt, Artificial Sequence
  Description of Artificial Sequence: Synthetic oligonucleotide
  Description of Combined DNA/RNA Molecule: Synthetic oligonucleotide
uggaaguuuaugcuaauauug

SEQ ID NO: 4103 - RNA, 21 nt, Artificial Sequence
  Description of Artificial Sequence: Synthetic oligonucleotide
  Description of Combined DNA/RNA Molecule: Synthetic oligonucleotide
ggaaguuuaugcuaauauugu

SEQ ID NO: 4104 - RNA, 21 nt, Artificial Sequence
  Description of Artificial Sequence: Synthetic oligonucleotide
  Description of Combined DNA/RNA Molecule: Synthetic oligonucleotide
aaguuuaugcuaauauugugu

SEQ ID NO: 4105 - RNA, 21 nt, Artificial Sequence
  Description of Artificial Sequence: Synthetic oligonucleotide
  Description of Combined DNA/RNA Molecule: Synthetic oligonucleotide
ugcuaauauuguguaacugau

SEQ ID NO: 4106 - RNA, 21 nt, Artificial Sequence
  Description of Artificial Sequence: Synthetic oligonucleotide
  Description of Combined DNA/RNA Molecule: Synthetic oligonucleotide
cuaauauuguguaacugauau

SEQ ID NO: 4107 - RNA, 21 nt, Artificial Sequence
  Description of Artificial Sequence: Synthetic oligonucleotide
  Description of Combined DNA/RNA Molecule: Synthetic oligonucleotide
aauauuguguaacugauauua

SEQ ID NO: 4108 - RNA, 21 nt, Artificial Sequence
  Description of Artificial Sequence: Synthetic oligonucleotide
  Description of Combined DNA/RNA Molecule: Synthetic oligonucleotide
aacugauauuaaaccuaaaug

SEQ ID NO: 4109 - RNA, 21 nt, Artificial Sequence
  Description of Artificial Sequence: Synthetic oligonucleotide
  Description of Combined DNA/RNA Molecule: Synthetic oligonucleotide
cuguugguauaaagauauuuu

SEQ ID NO: 4110 - RNA, 21 nt, Artificial Sequence
  Description of Artificial Sequence: Synthetic oligonucleotide
  Description of Combined DNA/RNA Molecule: Synthetic oligonucleotide
gguauaaagauauuuugagca

SEQ ID NO: 4111 - RNA, 21 nt, Artificial Sequence
  Description of Artificial Sequence: Synthetic oligonucleotide
  Description of Combined DNA/RNA Molecule: Synthetic oligonucleotide
uaaagauauuuugagcagacu

SEQ ID NO: 4112 - RNA, 21 nt, Artificial Sequence
  Description of Artificial Sequence: Synthetic oligonucleotide
  Description of Combined DNA/RNA Molecule: Synthetic oligonucleotide
aaagauauuuugagcagacug

SEQ ID NO: 4113 - RNA, 21 nt, Artificial Sequence
  Description of Artificial Sequence: Synthetic oligonucleotide
  Description of Combined DNA/RNA Molecule: Synthetic oligonucleotide
aagauauuuugagcagacugu

SEQ ID NO: 4114 - RNA, 21 nt, Artificial Sequence
  Description of Artificial Sequence: Synthetic oligonucleotide
  Description of Combined DNA/RNA Molecule: Synthetic oligonucleotide
auuuugagcagacuguaaaca

SEQ ID NO: 4115 - RNA, 21 nt, Artificial Sequence
  Description of Artificial Sequence: Synthetic oligonucleotide
  Description of Combined DNA/RNA Molecule: Synthetic oligonucleotide
uuugagcagacuguaaacaag

SEQ ID NO: 4116 - RNA, 21 nt, Artificial Sequence
  Description of Artificial Sequence: Synthetic oligonucleotide
  Description of Combined DNA/RNA Molecule: Synthetic oligonucleotide
agcagacuguaaacaagaaaa

SEQ ID NO: 4117 - RNA, 21 nt, Artificial Sequence
  Description of Artificial Sequence: Synthetic oligonucleotide
  Description of Combined DNA/RNA Molecule: Synthetic oligonucleotide
gacuguaaacaagaaaaaaaa

SEQ ID NO: 4118 - RNA, 21 nt, Artificial Sequence
  Description of Artificial Sequence: Synthetic oligonucleotide
  Description of Combined DNA/RNA Molecule: Synthetic oligonucleotide
acuguaaacaagaaaaaaaaa

SEQ ID NO: 4119 - RNA, 21 nt, Artificial Sequence
  Description of Artificial Sequence: Synthetic oligonucleotide
  Description of Combined DNA/RNA Molecule: Synthetic oligonucleotide
aaaaaaaaaaucaugcauucu

SEQ ID NO: 4120 - RNA, 21 nt, Artificial Sequence
  Description of Artificial Sequence: Synthetic oligonucleotide
  Description of Combined DNA/RNA Molecule: Synthetic oligonucleotide
aaaaaaaaaucaugcauucuu

SEQ ID NO: 4121 - RNA, 21 nt, Artificial Sequence
  Description of Artificial Sequence: Synthetic oligonucleotide
  Description of Combined DNA/RNA Molecule: Synthetic oligonucleotide
aucaugcauucuuagcaaaau

SEQ ID NO: 4122 - RNA, 21 nt, Artificial Sequence
  Description of Artificial Sequence: Synthetic oligonucleotide
  Description of Combined DNA/RNA Molecule: Synthetic oligonucleotide
uucuuagcaaaauugccuagu

SEQ ID NO: 4123 - RNA, 21 nt, Artificial Sequence
  Description of Artificial Sequence: Synthetic oligonucleotide
  Description of Combined DNA/RNA Molecule: Synthetic oligonucleotide
ucuuagcaaaauugccuagua

SEQ ID NO: 4124 - RNA, 21 nt, Artificial Sequence
  Description of Artificial Sequence: Synthetic oligonucleotide
  Description of Combined DNA/RNA Molecule: Synthetic oligonucleotide
gcaaaauugccuaguauguua

SEQ ID NO: 4125 - RNA, 21 nt, Artificial Sequence
  Description of Artificial Sequence: Synthetic oligonucleotide
  Description of Combined DNA/RNA Molecule: Synthetic oligonucleotide
aaaauugccuaguauguuaau

SEQ ID NO: 4126 - RNA, 21 nt, Artificial Sequence
  Description of Artificial Sequence: Synthetic oligonucleotide
  Description of Combined DNA/RNA Molecule: Synthetic oligonucleotide
aaauugccuaguauguuaauu

SEQ ID NO: 4127 - RNA, 21 nt, Artificial Sequence
  Description of Artificial Sequence: Synthetic oligonucleotide
  Description of Combined DNA/RNA Molecule: Synthetic oligonucleotide
ccuaguauguuaauuugcuca

SEQ ID NO: 4128 - RNA, 21 nt, Artificial Sequence
  Description of Artificial Sequence: Synthetic oligonucleotide
  Description of Combined DNA/RNA Molecule: Synthetic oligonucleotide
cuaguauguuaauuugcucaa

SEQ ID NO: 4129 - RNA, 21 nt, Artificial Sequence
  Description of Artificial Sequence: Synthetic oligonucleotide
  Description of Combined DNA/RNA Molecule: Synthetic oligonucleotide
uaguauguuaauuugcucaaa

SEQ ID NO: 4130 - RNA, 21 nt, Artificial Sequence
  Description of Artificial Sequence: Synthetic oligonucleotide
  Description of Combined DNA/RNA Molecule: Synthetic oligonucleotide
guuaauuugcucaaaauacaa

SEQ ID NO: 4131 - RNA, 21 nt, Artificial Sequence
  Description of Artificial Sequence: Synthetic oligonucleotide
  Description of Combined DNA/RNA Molecule: Synthetic oligonucleotide
uuaauuugcucaaaauacaau

SEQ ID NO: 4132 - RNA, 21 nt, Artificial Sequence
  Description of Artificial Sequence: Synthetic oligonucleotide
  Description of Combined DNA/RNA Molecule: Synthetic oligonucleotide
aauuugcucaaaauacaaugu

SEQ ID NO: 4133 - RNA, 21 nt, Artificial Sequence
  Description of Artificial Sequence: Synthetic oligonucleotide
  Description of Combined DNA/RNA Molecule: Synthetic oligonucleotide
cucaaaauacaauguuugauu

SEQ ID NO: 4134 - RNA, 21 nt, Artificial Sequence
  Description of Artificial Sequence: Synthetic oligonucleotide
  Description of Combined DNA/RNA Molecule: Synthetic oligonucleotide
caaaauacaauguuugauuuu

SEQ ID NO: 4135 - RNA, 21 nt, Artificial Sequence
  Description of Artificial Sequence: Synthetic oligonucleotide
  Description of Combined DNA/RNA Molecule: Synthetic oligonucleotide
aaaauacaauguuugauuuua

SEQ ID NO: 4136 - RNA, 21 nt, Artificial Sequence
  Description of Artificial Sequence: Synthetic oligonucleotide
  Description of Combined DNA/RNA Molecule: Synthetic oligonucleotide
caauguuugauuuuaugcacu

SEQ ID NO: 4137 - RNA, 21 nt, Artificial Sequence
  Description of Artificial Sequence: Synthetic oligonucleotide
  Description of Combined DNA/RNA Molecule: Synthetic oligonucleotide
aauguuugauuuuaugcacuu

SEQ ID NO: 4138 - RNA, 21 nt, Artificial Sequence
  Description of Artificial Sequence: Synthetic oligonucleotide
  Description of Combined DNA/RNA Molecule: Synthetic oligonucleotide
uuuaugcacuuugucgcuauu

SEQ ID NO: 4139 - RNA, 21 nt, Artificial Sequence
  Description of Artificial Sequence: Synthetic oligonucleotide
  Description of Combined DNA/RNA Molecule: Synthetic oligonucleotide
cuuugucgcuauuaacauccu

SEQ ID NO: 4140 - RNA, 21 nt, Artificial Sequence
  Description of Artificial Sequence: Synthetic oligonucleotide
  Description of Combined DNA/RNA Molecule: Synthetic oligonucleotide
cuuuuuuucauguagauuuca

SEQ ID NO: 4141 - RNA, 21 nt, Artificial Sequence
  Description of Artificial Sequence: Synthetic oligonucleotide
  Description of Combined DNA/RNA Molecule: Synthetic oligonucleotide
uuuuuuucauguagauuucaa

SEQ ID NO: 4142 - RNA, 21 nt, Artificial Sequence
  Description of Artificial Sequence: Synthetic oligonucleotide
  Description of Combined DNA/RNA Molecule: Synthetic oligonucleotide
uucauguagauuucaauaauu

SEQ ID NO: 4143 - RNA, 21 nt, Artificial Sequence
  Description of Artificial Sequence: Synthetic oligonucleotide
  Description of Combined DNA/RNA Molecule: Synthetic oligonucleotide
ucauguagauuucaauaauug

SEQ ID NO: 4144 - RNA, 21 nt, Artificial Sequence
  Description of Artificial Sequence: Synthetic oligonucleotide
  Description of Combined DNA/RNA Molecule: Synthetic oligonucleotide
cauguagauuucaauaauuga

SEQ ID NO: 4145 - RNA, 21 nt, Artificial Sequence
  Description of Artificial Sequence: Synthetic oligonucleotide
  Description of Combined DNA/RNA Molecule: Synthetic oligonucleotide
auguagauuucaauaauugag

SEQ ID NO: 4146 - RNA, 21 nt, Artificial Sequence
  Description of Artificial Sequence: Synthetic oligonucleotide
  Description of Combined DNA/RNA Molecule: Synthetic oligonucleotide
uguagauuucaauaauugagu

SEQ ID NO: 4147 - RNA, 21 nt, Artificial Sequence
  Description of Artificial Sequence: Synthetic oligonucleotide
  Description of Combined DNA/RNA Molecule: Synthetic oligonucleotide
guagauuucaauaauugagua

SEQ ID NO: 4148 - RNA, 21 nt, Artificial Sequence
  Description of Artificial Sequence: Synthetic oligonucleotide
  Description of Combined DNA/RNA Molecule: Synthetic oligonucleotide
uagauuucaauaauugaguaa

SEQ ID NO: 4149 - RNA, 21 nt, Artificial Sequence
  Description of Artificial Sequence: Synthetic oligonucleotide
  Description of Combined DNA/RNA Molecule: Synthetic oligonucleotide
agauuucaauaauugaguaau

SEQ ID NO: 4150 - RNA, 21 nt, Artificial Sequence
  Description of Artificial Sequence: Synthetic oligonucleotide
  Description of Combined DNA/RNA Molecule: Synthetic oligonucleotide
caauaauugaguaauuuuaga

SEQ ID NO: 4151 - RNA, 21 nt, Artificial Sequence
  Description of Artificial Sequence: Synthetic oligonucleotide
  Description of Combined DNA/RNA Molecule: Synthetic oligonucleotide
aauugaguaauuuuagaagca

SEQ ID NO: 4152 - RNA, 21 nt, Artificial Sequence
  Description of Artificial Sequence: Synthetic oligonucleotide
  Description of Combined DNA/RNA Molecule: Synthetic oligonucleotide
auugaguaauuuuagaagcau

SEQ ID NO: 4153 - RNA, 21 nt, Artificial Sequence
  Description of Artificial Sequence: Synthetic oligonucleotide
  Description of Combined DNA/RNA Molecule: Synthetic oligonucleotide
ugaguaauuuuagaagcauua

SEQ ID NO: 4154 - RNA, 21 nt, Artificial Sequence
  Description of Artificial Sequence: Synthetic oligonucleotide
  Description of Combined DNA/RNA Molecule: Synthetic oligonucleotide
uaauuuuagaagcauuauuuu

SEQ ID NO: 4155 - RNA, 21 nt, Artificial Sequence
  Description of Artificial Sequence: Synthetic oligonucleotide
  Description of Combined DNA/RNA Molecule: Synthetic oligonucleotide
uuuagaagcauuauuuuagga

SEQ ID NO: 4156 - RNA, 21 nt, Artificial Sequence
  Description of Artificial Sequence: Synthetic oligonucleotide
  Description of Combined DNA/RNA Molecule: Synthetic oligonucleotide
uagaagcauuauuuuaggaau

SEQ ID NO: 4157 - RNA, 21 nt, Artificial Sequence
  Description of Artificial Sequence: Synthetic oligonucleotide
  Description of Combined DNA/RNA Molecule: Synthetic oligonucleotide
agcauuauuuuaggaauauau

SEQ ID NO: 4158 - RNA, 21 nt, Artificial Sequence
  Description of Artificial Sequence: Synthetic oligonucleotide
  Description of Combined DNA/RNA Molecule: Synthetic oligonucleotide
cauuauuuuaggaauauauag

SEQ ID NO: 4159 - RNA, 21 nt, Artificial Sequence
  Description of Artificial Sequence: Synthetic oligonucleotide
  Description of Combined DNA/RNA Molecule: Synthetic oligonucleotide
uaggaauauauaguugucaca

SEQ ID NO: 4160 - RNA, 21 nt, Artificial Sequence
  Description of Artificial Sequence: Synthetic oligonucleotide
  Description of Combined DNA/RNA Molecule: Synthetic oligonucleotide
aggaauauauaguugucacag

SEQ ID NO: 4161 - RNA, 21 nt, Artificial Sequence
  Description of Artificial Sequence: Synthetic oligonucleotide
  Description of Combined DNA/RNA Molecule: Synthetic oligonucleotide
ggaauauauaguugucacagu

SEQ ID NO: 4162 - RNA, 21 nt, Artificial Sequence
  Description of Artificial Sequence: Synthetic oligonucleotide
  Description of Combined DNA/RNA Molecule: Synthetic oligonucleotide
aauauauaguugucacaguaa

SEQ ID NO: 4163 - RNA, 21 nt, Artificial Sequence
  Description of Artificial Sequence: Synthetic oligonucleotide
  Description of Combined DNA/RNA Molecule: Synthetic oligonucleotide
auauauaguugucacaguaaa

SEQ ID NO: 4164 - RNA, 21 nt, Artificial Sequence
  Description of Artificial Sequence: Synthetic oligonucleotide
  Description of Combined DNA/RNA Molecule: Synthetic oligonucleotide
uaguugucacaguaaauaucu

SEQ ID NO: 4165 - RNA, 21 nt, Artificial Sequence
  Description of Artificial Sequence: Synthetic oligonucleotide
  Description of Combined DNA/RNA Molecule: Synthetic oligonucleotide
aguugucacaguaaauaucuu

SEQ ID NO: 4166 - RNA, 21 nt, Artificial Sequence
  Description of Artificial Sequence: Synthetic oligonucleotide
  Description of Combined DNA/RNA Molecule: Synthetic oligonucleotide
guaaauaucuuguuuuuucua

SEQ ID NO: 4167 - RNA, 21 nt, Artificial Sequence
  Description of Artificial Sequence: Synthetic oligonucleotide
  Description of Combined DNA/RNA Molecule: Synthetic oligonucleotide
uaaauaucuuguuuuuucuau

SEQ ID NO: 4168 - RNA, 21 nt, Artificial Sequence
  Description of Artificial Sequence: Synthetic oligonucleotide
  Description of Combined DNA/RNA Molecule: Synthetic oligonucleotide
aucuuguuuuuucuauguaca

SEQ ID NO: 4169 - RNA, 21 nt, Artificial Sequence
  Description of Artificial Sequence: Synthetic oligonucleotide
  Description of Combined DNA/RNA Molecule: Synthetic oligonucleotide
ucuuguuuuuucuauguacau

SEQ ID NO: 4170 - RNA, 21 nt, Artificial Sequence
  Description of Artificial Sequence: Synthetic oligonucleotide
  Description of Combined DNA/RNA Molecule: Synthetic oligonucleotide
cuuguuuuuucuauguacauu

SEQ ID NO: 4171 - RNA, 21 nt, Artificial Sequence
  Description of Artificial Sequence: Synthetic oligonucleotide
  Description of Combined DNA/RNA Molecule: Synthetic oligonucleotide
uuguuuuuucuauguacauug

SEQ ID NO: 4172 - RNA, 21 nt, Artificial Sequence
  Description of Artificial Sequence: Synthetic oligonucleotide
  Description of Combined DNA/RNA Molecule: Synthetic oligonucleotide
uucuauguacauuguacaaau

SEQ ID NO: 4173 - RNA, 21 nt, Artificial Sequence
  Description of Artificial Sequence: Synthetic oligonucleotide
  Description of Combined DNA/RNA Molecule: Synthetic oligonucleotide
ucuauguacauuguacaaauu

SEQ ID NO: 4174 - RNA, 21 nt, Artificial Sequence
  Description of Artificial Sequence: Synthetic oligonucleotide
  Description of Combined DNA/RNA Molecule: Synthetic oligonucleotide
auuuuucauuccuuuugcucu

SEQ ID NO: 4175 - RNA, 21 nt, Artificial Sequence
  Description of Artificial Sequence: Synthetic oligonucleotide
  Description of Combined DNA/RNA Molecule: Synthetic oligonucleotide
ugguuggaucuaacacuaacu

SEQ ID NO: 4176 - RNA, 21 nt, Artificial Sequence
  Description of Artificial Sequence: Synthetic oligonucleotide
  Description of Combined DNA/RNA Molecule: Synthetic oligonucleotide
gguuggaucuaacacuaacug

SEQ ID NO: 4177 - RNA, 21 nt, Artificial Sequence
  Description of Artificial Sequence: Synthetic oligonucleotide
  Description of Combined DNA/RNA Molecule: Synthetic oligonucleotide
uuggaucuaacacuaacugua

SEQ ID NO: 4178 - RNA, 21 nt, Artificial Sequence
  Description of Artificial Sequence: Synthetic oligonucleotide
  Description of Combined DNA/RNA Molecule: Synthetic oligonucleotide
cuguauuguuuuguuacauca

SEQ ID NO: 4179 - RNA, 21 nt, Artificial Sequence
  Description of Artificial Sequence: Synthetic oligonucleotide
  Description of Combined DNA/RNA Molecule: Synthetic oligonucleotide
uguauuguuuuguuacaucaa

SEQ ID NO: 4180 - RNA, 21 nt, Artificial Sequence
  Description of Artificial Sequence: Synthetic oligonucleotide
  Description of Combined DNA/RNA Molecule: Synthetic oligonucleotide
guauuguuuuguuacaucaaa

SEQ ID NO: 4181 - RNA, 21 nt, Artificial Sequence
  Description of Artificial Sequence: Synthetic oligonucleotide
  Description of Combined DNA/RNA Molecule: Synthetic oligonucleotide
auuguuuuguuacaucaaaua

SEQ ID NO: 4182 - RNA, 21 nt, Artificial Sequence
  Description of Artificial Sequence: Synthetic oligonucleotide
  Description of Combined DNA/RNA Molecule: Synthetic oligonucleotide
ucuguggaccaggcaaaaaaa

SEQ ID NO: 4183 - RNA, 21 nt, Artificial Sequence
  Description of Artificial Sequence: Synthetic oligonucleotide
  Description of Combined DNA/RNA Molecule: Synthetic oligonucleotide
cuguggaccaggcaaaaaaaa

SEQ ID NO: 4184 - RNA, 21 nt, Artificial Sequence
  Description of Artificial Sequence: Synthetic oligonucleotide
  Description of Combined DNA/RNA Molecule: Synthetic oligonucleotide
accaggcaaaaaaaaaaaaaa

SEQ ID NO: 4185 - RNA, 21 nt, Artificial Sequence
  Description of Artificial Sequence: Synthetic oligonucleotide
  Description of Combined DNA/RNA Molecule: Synthetic oligonucleotide
cacuuuuucaagcaguaggaa

SEQ ID NO: 4186 - RNA, 21 nt, Artificial Sequence
  Description of Artificial Sequence: Synthetic oligonucleotide
  Description of Combined DNA/RNA Molecule: Synthetic oligonucleotide
acuuuuucaagcaguaggaau

SEQ ID NO: 4187 - RNA, 21 nt, Artificial Sequence
  Description of Artificial Sequence: Synthetic oligonucleotide
  Description of Combined DNA/RNA Molecule: Synthetic oligonucleotide
uucaagcaguaggaauuauuu

SEQ ID NO: 4188 - RNA, 21 nt, Artificial Sequence
  Description of Artificial Sequence: Synthetic oligonucleotide
  Description of Combined DNA/RNA Molecule: Synthetic oligonucleotide
agcaguaggaauuauuuagca

SEQ ID NO: 4189 - RNA, 21 nt, Artificial Sequence
  Description of Artificial Sequence: Synthetic oligonucleotide
  Description of Combined DNA/RNA Molecule: Synthetic oligonucleotide
caguaggaauuauuuagcaug

SEQ ID NO: 4190 - RNA, 21 nt, Artificial Sequence
  Description of Artificial Sequence: Synthetic oligonucleotide
  Description of Combined DNA/RNA Molecule: Synthetic oligonucleotide
aguaggaauuauuuagcaugu

SEQ ID NO: 4191 - RNA, 21 nt, Artificial Sequence
  Description of Artificial Sequence: Synthetic oligonucleotide
  Description of Combined DNA/RNA Molecule: Synthetic oligonucleotide
guaggaauuauuuagcaugua

SEQ ID NO: 4192 - DNA, 21 bp, Artificial Sequence
  Description of Artificial Sequence: Synthetic oligonucleotide
  Description of Combined DNA/RNA Molecule: Synthetic oligonucleotide
ccgcgcgcccgagcgcgcctc

SEQ ID NO: 4193 - DNA, 21 bp, Artificial Sequence
  Description of Artificial Sequence: Synthetic oligonucleotide
  Description of Combined DNA/RNA Molecule: Synthetic oligonucleotide
gcgcgcccgagcgcgcctccg

SEQ ID NO: 4194 - DNA, 21 bp, Artificial Sequence
  Description of Artificial Sequence: Synthetic oligonucleotide
  Description of Combined DNA/RNA Molecule: Synthetic oligonucleotide
gcgcccgagcgcgcctccgcc

SEQ ID NO: 4195 - DNA, 21 bp, Artificial Sequence
  Description of Artificial Sequence: Synthetic oligonucleotide
  Description of Combined DNA/RNA Molecule: Synthetic oligonucleotide
gcccgagcgcgcctccgccct

SEQ ID NO: 4196 - DNA, 21 bp, Artificial Sequence
  Description of Artificial Sequence: Synthetic oligonucleotide
  Description of Combined DNA/RNA Molecule: Synthetic oligonucleotide
ccgagcgcgcctccgcccttg

SEQ ID NO: 4197 - DNA, 21 bp, Artificial Sequence
  Description of Artificial Sequence: Synthetic oligonucleotide
  Description of Combined DNA/RNA Molecule: Synthetic oligonucleotide
gctgcctcagctcctcagtgc

SEQ ID NO: 4198 - DNA, 21 bp, Artificial Sequence
  Description of Artificial Sequence: Synthetic oligonucleotide
  Description of Combined DNA/RNA Molecule: Synthetic oligonucleotide
ctgcctcagctcctcagtgca

SEQ ID NO: 4199 - DNA, 21 bp, Artificial Sequence
  Description of Artificial Sequence: Synthetic oligonucleotide
  Description of Combined DNA/RNA Molecule: Synthetic oligonucleotide
gcctcagctcctcagtgcaca

SEQ ID NO: 4200 - DNA, 21 bp, Artificial Sequence
  Description of Artificial Sequence: Synthetic oligonucleotide
  Description of Combined DNA/RNA Molecule: Synthetic oligonucleotide
cagctcctcagtgcacagtgc

SEQ ID NO: 4201 - DNA, 21 bp, Artificial Sequence
  Description of Artificial Sequence: Synthetic oligonucleotide
  Description of Combined DNA/RNA Molecule: Synthetic oligonucleotide
agctcctcagtgcacagtgct

SEQ ID NO: 4202 - DNA, 21 bp, Artificial Sequence
  Description of Artificial Sequence: Synthetic oligonucleotide
  Description of Combined DNA/RNA Molecule: Synthetic oligonucleotide
gtgctgcctcgtctgagggga

SEQ ID NO: 4203 - DNA, 21 bp, Artificial Sequence
  Description of Artificial Sequence: Synthetic oligonucleotide
  Description of Combined DNA/RNA Molecule: Synthetic oligonucleotide
gattgccgcccgcttctctct

SEQ ID NO: 4204 - DNA, 21 bp, Artificial Sequence
  Description of Artificial Sequence: Synthetic oligonucleotide
  Description of Combined DNA/RNA Molecule: Synthetic oligonucleotide
ttgccgcccgcttctctctag

SEQ ID NO: 4205 - DNA, 21 bp, Artificial Sequence
  Description of Artificial Sequence: Synthetic oligonucleotide
  Description of Combined DNA/RNA Molecule: Synthetic oligonucleotide
tgccgcccgcttctctctagt

SEQ ID NO: 4206 - DNA, 21 bp, Artificial Sequence
  Description of Artificial Sequence: Synthetic oligonucleotide
  Description of Combined DNA/RNA Molecule: Synthetic oligonucleotide
acgaggggtttcccgcctcgc

SEQ ID NO: 4207 - DNA, 21 bp, Artificial Sequence
  Description of Artificial Sequence: Synthetic oligonucleotide
  Description of Combined DNA/RNA Molecule: Synthetic oligonucleotide
acctctggacttgcctttcct

SEQ ID NO: 4208 - DNA, 21 bp, Artificial Sequence
  Description of Artificial Sequence: Synthetic oligonucleotide
  Description of Combined DNA/RNA Molecule: Synthetic oligonucleotide
tctggacttgcctttccttct

SEQ ID NO: 4209 - DNA, 21 bp, Artificial Sequence
  Description of Artificial Sequence: Synthetic oligonucleotide
  Description of Combined DNA/RNA Molecule: Synthetic oligonucleotide
tggacttgcctttccttctct

SEQ ID NO: 4210 - DNA, 21 bp, Artificial Sequence
  Description of Artificial Sequence: Synthetic oligonucleotide
  Description of Combined DNA/RNA Molecule: Synthetic oligonucleotide
acttgcctttccttctcttct

SEQ ID NO: 4211 - DNA, 21 bp, Artificial Sequence
  Description of Artificial Sequence: Synthetic oligonucleotide
  Description of Combined DNA/RNA Molecule: Synthetic oligonucleotide
ttgcctttccttctcttctcc

SEQ ID NO: 4212 - DNA, 21 bp, Artificial Sequence
  Description of Artificial Sequence: Synthetic oligonucleotide
  Description of Combined DNA/RNA Molecule: Synthetic oligonucleotide
tgcctttccttctcttctccg

SEQ ID NO: 4213 - DNA, 21 bp, Artificial Sequence
  Description of Artificial Sequence: Synthetic oligonucleotide
  Description of Combined DNA/RNA Molecule: Synthetic oligonucleotide
gcctttccttctcttctccgc

SEQ ID NO: 4214 - DNA, 21 bp, Artificial Sequence
  Description of Artificial Sequence: Synthetic oligonucleotide
  Description of Combined DNA/RNA Molecule: Synthetic oligonucleotide
tcttctccgcgtgtggaggga

SEQ ID NO: 4215 - DNA, 21 bp, Artificial Sequence
  Description of Artificial Sequence: Synthetic oligonucleotide
  Description of Combined DNA/RNA Molecule: Synthetic oligonucleotide
ttctccgcgtgtggagggagc

SEQ ID NO: 4216 - DNA, 21 bp, Artificial Sequence
  Description of Artificial Sequence: Synthetic oligonucleotide
  Description of Combined DNA/RNA Molecule: Synthetic oligonucleotide
ctccgcgtgtggagggagcca

SEQ ID NO: 4217 - DNA, 21 bp, Artificial Sequence
  Description of Artificial Sequence: Synthetic oligonucleotide
  Description of Combined DNA/RNA Molecule: Synthetic oligonucleotide
gggagccagcgcttaggccgg

SEQ ID NO: 4218 - DNA, 21 bp, Artificial Sequence
  Description of Artificial Sequence: Synthetic oligonucleotide
  Description of Combined DNA/RNA Molecule: Synthetic oligonucleotide
gtgaagacatcgcggggaccg

SEQ ID NO: 4219 - DNA, 21 bp, Artificial Sequence
  Description of Artificial Sequence: Synthetic oligonucleotide
  Description of Combined DNA/RNA Molecule: Synthetic oligonucleotide
cgattcaccatggagggcgcc

SEQ ID NO: 4220 - DNA, 21 bp, Artificial Sequence
  Description of Artificial Sequence: Synthetic oligonucleotide
  Description of Combined DNA/RNA Molecule: Synthetic oligonucleotide
caccatggagggcgccggcgg

SEQ ID NO: 4221 - DNA, 21 bp, Artificial Sequence
  Description of Artificial Sequence: Synthetic oligonucleotide
  Description of Combined DNA/RNA Molecule: Synthetic oligonucleotide
ccatggagggcgccggcggcg

SEQ ID NO: 4222 - DNA, 21 bp, Artificial Sequence
  Description of Artificial Sequence: Synthetic oligonucleotide
  Description of Combined DNA/RNA Molecule: Synthetic oligonucleotide
cgcgaacgacaagaaaaagat

SEQ ID NO: 4223 - DNA, 21 bp, Artificial Sequence
  Description of Artificial Sequence: Synthetic oligonucleotide
  Description of Combined DNA/RNA Molecule: Synthetic oligonucleotide
gacaagaaaaagataagttct

SEQ ID NO: 4224 - DNA, 21 bp, Artificial Sequence
  Description of Artificial Sequence: Synthetic oligonucleotide
  Description of Combined DNA/RNA Molecule: Synthetic oligonucleotide
aagttctgaacgtcgaaaaga

SEQ ID NO: 4225 - DNA, 21 bp, Artificial Sequence
  Description of Artificial Sequence: Synthetic oligonucleotide
  Description of Combined DNA/RNA Molecule: Synthetic oligonucleotide
gttctgaacgtcgaaaagaaa

SEQ ID NO: 4226 - DNA, 21 bp, Artificial Sequence
  Description of Artificial Sequence: Synthetic oligonucleotide
  Description of Combined DNA/RNA Molecule: Synthetic oligonucleotide
tctgaacgtcgaaaagaaaag

SEQ ID NO: 4227 - DNA, 21 bp, Artificial Sequence
  Description of Artificial Sequence: Synthetic oligonucleotide
  Description of Combined DNA/RNA Molecule: Synthetic oligonucleotide
tgaacgtcgaaaagaaaagtc

SEQ ID NO: 4228 - DNA, 21 bp, Artificial Sequence
  Description of Artificial Sequence: Synthetic oligonucleotide
  Description of Combined DNA/RNA Molecule: Synthetic oligonucleotide
aagaatctgaagttttttatg

SEQ ID NO: 4229 - DNA, 21 bp, Artificial Sequence
  Description of Artificial Sequence: Synthetic oligonucleotide
  Description of Combined DNA/RNA Molecule: Synthetic oligonucleotide
aatctgaagttttttatgagc

SEQ ID NO: 4230 - DNA, 21 bp, Artificial Sequence
  Description of Artificial Sequence: Synthetic oligonucleotide
  Description of Combined DNA/RNA Molecule: Synthetic oligonucleotide
tctgaagttttttatgagctt

SEQ ID NO: 4231 - DNA, 21 bp, Artificial Sequence
  Description of Artificial Sequence: Synthetic oligonucleotide
  Description of Combined DNA/RNA Molecule: Synthetic oligonucleotide
tgaagttttttatgagcttgc

SEQ ID NO: 4232 - DNA, 21 bp, Artificial Sequence
  Description of Artificial Sequence: Synthetic oligonucleotide
  Description of Combined DNA/RNA Molecule: Synthetic oligonucleotide
aagttttttatgagcttgctc

SEQ ID NO: 4233 - DNA, 21 bp, Artificial Sequence
  Description of Artificial Sequence: Synthetic oligonucleotide
  Description of Combined DNA/RNA Molecule: Synthetic oligonucleotide
gttttttatgagcttgctcat

SEQ ID NO: 4234 - DNA, 21 bp, Artificial Sequence
  Description of Artificial Sequence: Synthetic oligonucleotide
  Description of Combined DNA/RNA Molecule: Synthetic oligonucleotide
tttttatgagcttgctcatca

SEQ ID NO: 4235 - DNA, 21 bp, Artificial Sequence
  Description of Artificial Sequence: Synthetic oligonucleotide
  Description of Combined DNA/RNA Molecule: Synthetic oligonucleotide
tttatgagcttgctcatcagt

SEQ ID NO: 4236 - DNA, 21 bp, Artificial Sequence
  Description of Artificial Sequence: Synthetic oligonucleotide
  Description of Combined DNA/RNA Molecule: Synthetic oligonucleotide
tatgagcttgctcatcagttg

SEQ ID NO: 4237 - DNA, 21 bp, Artificial Sequence
  Description of Artificial Sequence: Synthetic oligonucleotide
  Description of Combined DNA/RNA Molecule: Synthetic oligonucleotide
tgagcttgctcatcagttgcc

SEQ ID NO: 4238 - DNA, 21 bp, Artificial Sequence
  Description of Artificial Sequence: Synthetic oligonucleotide
  Description of Combined DNA/RNA Molecule: Synthetic oligonucleotide
agcttgctcatcagttgccac

SEQ ID NO: 4239 - DNA, 21 bp, Artificial Sequence
  Description of Artificial Sequence: Synthetic oligonucleotide
  Description of Combined DNA/RNA Molecule: Synthetic oligonucleotide
cttgctcatcagttgccactt

SEQ ID NO: 4240 - DNA, 21 bp, Artificial Sequence
  Description of Artificial Sequence: Synthetic oligonucleotide
  Description of Combined DNA/RNA Molecule: Synthetic oligonucleotide
tgctcatcagttgccacttcc

SEQ ID NO: 4241 - DNA, 21 bp, Artificial Sequence
  Description of Artificial Sequence: Synthetic oligonucleotide
  Description of Combined DNA/RNA Molecule: Synthetic oligonucleotide
gccacttccacataatgtgag

SEQ ID NO: 4242 - DNA, 21 bp, Artificial Sequence
  Description of Artificial Sequence: Synthetic oligonucleotide
  Description of Combined DNA/RNA Molecule: Synthetic oligonucleotide
aacttctggatgctggtgatt

SEQ ID NO: 4243 - DNA, 21 bp, Artificial Sequence
  Description of Artificial Sequence: Synthetic oligonucleotide
  Description of Combined DNA/RNA Molecule: Synthetic oligonucleotide
cttctggatgctggtgatttg

SEQ ID NO: 4244 - DNA, 21 bp, Artificial Sequence
  Description of Artificial Sequence: Synthetic oligonucleotide
  Description of Combined DNA/RNA Molecule: Synthetic oligonucleotide
ttctggatgctggtgatttgg

SEQ ID NO: 4245 - DNA, 21 bp, Artificial Sequence
  Description of Artificial Sequence: Synthetic oligonucleotide
  Description of Combined DNA/RNA Molecule: Synthetic oligonucleotide
gatattgaagatgacatgaaa

SEQ ID NO: 4246 - DNA, 21 bp, Artificial Sequence
  Description of Artificial Sequence: Synthetic oligonucleotide
  Description of Combined DNA/RNA Molecule: Synthetic oligonucleotide
gatgaattgcttttatttgaa

SEQ ID NO: 4247 - DNA, 21 bp, Artificial Sequence
  Description of Artificial Sequence: Synthetic oligonucleotide
  Description of Combined DNA/RNA Molecule: Synthetic oligonucleotide
ttgaaagccttggatggtttt

SEQ ID NO: 4248 - DNA, 21 bp, Artificial Sequence
  Description of Artificial Sequence: Synthetic oligonucleotide
  Description of Combined DNA/RNA Molecule: Synthetic oligonucleotide
aagccttggatggttttgtta

SEQ ID NO: 4249 - DNA, 21 bp, Artificial Sequence
  Description of Artificial Sequence: Synthetic oligonucleotide
  Description of Combined DNA/RNA Molecule: Synthetic oligonucleotide
gccttggatggttttgttatg

SEQ ID NO: 4250 - DNA, 21 bp, Artificial Sequence
  Description of Artificial Sequence: Synthetic oligonucleotide
  Description of Combined DNA/RNA Molecule: Synthetic oligonucleotide
cttggatggttttgttatggt

SEQ ID NO: 4251 - DNA, 21 bp, Artificial Sequence
  Description of Artificial Sequence: Synthetic oligonucleotide
  Description of Combined DNA/RNA Molecule: Synthetic oligonucleotide
tggatggttttgttatggttc

SEQ ID NO: 4252 - DNA, 21 bp, Artificial Sequence
  Description of Artificial Sequence: Synthetic oligonucleotide
  Description of Combined DNA/RNA Molecule: Synthetic oligonucleotide
tgatttacatttctgataatg

SEQ ID NO: 4253 - DNA, 21 bp, Artificial Sequence
  Description of Artificial Sequence: Synthetic oligonucleotide
  Description of Combined DNA/RNA Molecule: Synthetic oligonucleotide
gggattaactcagtttgaact

SEQ ID NO: 4254 - DNA, 21 bp, Artificial Sequence
  Description of Artificial Sequence: Synthetic oligonucleotide
  Description of Combined DNA/RNA Molecule: Synthetic oligonucleotide
attaactcagtttgaactaac

SEQ ID NO: 4255 - DNA, 21 bp, Artificial Sequence
  Description of Artificial Sequence: Synthetic oligonucleotide
  Description of Combined DNA/RNA Molecule: Synthetic oligonucleotide
gtgtttgattttactcatcca

SEQ ID NO: 4256 - DNA, 21 bp, Artificial Sequence
  Description of Artificial Sequence: Synthetic oligonucleotide
  Description of Combined DNA/RNA Molecule: Synthetic oligonucleotide
gtttgattttactcatccatg

SEQ ID NO: 4257 - DNA, 21 bp, Artificial Sequence
  Description of Artificial Sequence: Synthetic oligonucleotide
  Description of Combined DNA/RNA Molecule: Synthetic oligonucleotide
ttgattttactcatccatgtg

SEQ ID NO: 4258 - DNA, 21 bp, Artificial Sequence
  Description of Artificial Sequence: Synthetic oligonucleotide
  Description of Combined DNA/RNA Molecule: Synthetic oligonucleotide
gattttactcatccatgtgac

SEQ ID NO: 4259 - DNA, 21 bp, Artificial Sequence
  Description of Artificial Sequence: Synthetic oligonucleotide
  Description of Combined DNA/RNA Molecule: Synthetic oligonucleotide
ttttactcatccatgtgacca

SEQ ID NO: 4260 - DNA, 21 bp, Artificial Sequence
  Description of Artificial Sequence: Synthetic oligonucleotide
  Description of Combined DNA/RNA Molecule: Synthetic oligonucleotide
ttactcatccatgtgaccatg

SEQ ID NO: 4261 - DNA, 21 bp, Artificial Sequence
  Description of Artificial Sequence: Synthetic oligonucleotide
  Description of Combined DNA/RNA Molecule: Synthetic oligonucleotide
actcatccatgtgaccatgag

SEQ ID NO: 4262 - DNA, 21 bp, Artificial Sequence
  Description of Artificial Sequence: Synthetic oligonucleotide
  Description of Combined DNA/RNA Molecule: Synthetic oligonucleotide
tcatccatgtgaccatgagga

SEQ ID NO: 4263 - DNA, 21 bp, Artificial Sequence
  Description of Artificial Sequence: Synthetic oligonucleotide
  Description of Combined DNA/RNA Molecule: Synthetic oligonucleotide
atccatgtgaccatgaggaaa

SEQ ID NO: 4264 - DNA, 21 bp, Artificial Sequence
  Description of Artificial Sequence: Synthetic oligonucleotide
  Description of Combined DNA/RNA Molecule: Synthetic oligonucleotide
ccatgtgaccatgaggaaatg

SEQ ID NO: 4265 - DNA, 21 bp, Artificial Sequence
  Description of Artificial Sequence: Synthetic oligonucleotide
  Description of Combined DNA/RNA Molecule: Synthetic oligonucleotide
atgtgaccatgaggaaatgag

SEQ ID NO: 4266 - DNA, 21 bp, Artificial Sequence
  Description of Artificial Sequence: Synthetic oligonucleotide
  Description of Combined DNA/RNA Molecule: Synthetic oligonucleotide
gtgaccatgaggaaatgagag

SEQ ID NO: 4267 - DNA, 21 bp, Artificial Sequence
  Description of Artificial Sequence: Synthetic oligonucleotide
  Description of Combined DNA/RNA Molecule: Synthetic oligonucleotide
gaccatgaggaaatgagagaa

SEQ ID NO: 4268 - DNA, 21 bp, Artificial Sequence
  Description of Artificial Sequence: Synthetic oligonucleotide
  Description of Combined DNA/RNA Molecule: Synthetic oligonucleotide
ccatgaggaaatgagagaaat

SEQ ID NO: 4269 - DNA, 21 bp, Artificial Sequence
  Description of Artificial Sequence: Synthetic oligonucleotide
  Description of Combined DNA/RNA Molecule: Synthetic oligonucleotide
atgaggaaatgagagaaatgc

SEQ ID NO: 4270 - DNA, 21 bp, Artificial Sequence
  Description of Artificial Sequence: Synthetic oligonucleotide
  Description of Combined DNA/RNA Molecule: Synthetic oligonucleotide
agcgaagcttttttctcagaa

SEQ ID NO: 4271 - DNA, 21 bp, Artificial Sequence
  Description of Artificial Sequence: Synthetic oligonucleotide
  Description of Combined DNA/RNA Molecule: Synthetic oligonucleotide
aagcttttttctcagaatgaa

SEQ ID NO: 4272 - DNA, 21 bp, Artificial Sequence
  Description of Artificial Sequence: Synthetic oligonucleotide
  Description of Combined DNA/RNA Molecule: Synthetic oligonucleotide
gcttttttctcagaatgaagt

SEQ ID NO: 4273 - DNA, 21 bp, Artificial Sequence
  Description of Artificial Sequence: Synthetic oligonucleotide
  Description of Combined DNA/RNA Molecule: Synthetic oligonucleotide
tatatgataccaacagtaacc

SEQ ID NO: 4274 - DNA, 21 bp, Artificial Sequence
  Description of Artificial Sequence: Synthetic oligonucleotide
  Description of Combined DNA/RNA Molecule: Synthetic oligonucleotide
tatgataccaacagtaaccaa

SEQ ID NO: 4275 - DNA, 21 bp, Artificial Sequence
  Description of Artificial Sequence: Synthetic oligonucleotide
  Description of Combined DNA/RNA Molecule: Synthetic oligonucleotide
tgataccaacagtaaccaacc

SEQ ID NO: 4276 - DNA, 21 bp, Artificial Sequence
  Description of Artificial Sequence: Synthetic oligonucleotide
  Description of Combined DNA/RNA Molecule: Synthetic oligonucleotide
ataccaacagtaaccaacctc

SEQ ID NO: 4277 - DNA, 21 bp, Artificial Sequence
  Description of Artificial Sequence: Synthetic oligonucleotide
  Description of Combined DNA/RNA Molecule: Synthetic oligonucleotide
accaacagtaaccaacctcag

SEQ ID NO: 4278 - DNA, 21 bp, Artificial Sequence
  Description of Artificial Sequence: Synthetic oligonucleotide
  Description of Combined DNA/RNA Molecule: Synthetic oligonucleotide
caacagtaaccaacctcagtg

SEQ ID NO: 4279 - DNA, 21 bp, Artificial Sequence
  Description of Artificial Sequence: Synthetic oligonucleotide
  Description of Combined DNA/RNA Molecule: Synthetic oligonucleotide
acagtaaccaacctcagtgtg

SEQ ID NO: 4280 - DNA, 21 bp, Artificial Sequence
  Description of Artificial Sequence: Synthetic oligonucleotide
  Description of Combined DNA/RNA Molecule: Synthetic oligonucleotide
agtaaccaacctcagtgtggg

SEQ ID NO: 4281 - DNA, 21 bp, Artificial Sequence
  Description of Artificial Sequence: Synthetic oligonucleotide
  Description of Combined DNA/RNA Molecule: Synthetic oligonucleotide
taaccaacctcagtgtgggta

SEQ ID NO: 4282 - DNA, 21 bp, Artificial Sequence
  Description of Artificial Sequence: Synthetic oligonucleotide
  Description of Combined DNA/RNA Molecule: Synthetic oligonucleotide
cacctatgacctgcttggtgc

SEQ ID NO: 4283 - DNA, 21 bp, Artificial Sequence
  Description of Artificial Sequence: Synthetic oligonucleotide
  Description of Combined DNA/RNA Molecule: Synthetic oligonucleotide
acctatgacctgcttggtgct

SEQ ID NO: 4284 - DNA, 21 bp, Artificial Sequence
  Description of Artificial Sequence: Synthetic oligonucleotide
  Description of Combined DNA/RNA Molecule: Synthetic oligonucleotide
ctatgacctgcttggtgctga

SEQ ID NO: 4285 - DNA, 21 bp, Artificial Sequence
  Description of Artificial Sequence: Synthetic oligonucleotide
  Description of Combined DNA/RNA Molecule: Synthetic oligonucleotide
ctgcttggtgctgatttgtga

SEQ ID NO: 4286 - DNA, 21 bp, Artificial Sequence
  Description of Artificial Sequence: Synthetic oligonucleotide
  Description of Combined DNA/RNA Molecule: Synthetic oligonucleotide
gcttggtgctgatttgtgaac

SEQ ID NO: 4287 - DNA, 21 bp, Artificial Sequence
  Description of Artificial Sequence: Synthetic oligonucleotide
  Description of Combined DNA/RNA Molecule: Synthetic oligonucleotide
ttggtgctgatttgtgaaccc

SEQ ID NO: 4288 - DNA, 21 bp, Artificial Sequence
  Description of Artificial Sequence: Synthetic oligonucleotide
  Description of Combined DNA/RNA Molecule: Synthetic oligonucleotide
ggtgctgatttgtgaacccat

SEQ ID NO: 4289 - DNA, 21 bp, Artificial Sequence
  Description of Artificial Sequence: Synthetic oligonucleotide
  Description of Combined DNA/RNA Molecule: Synthetic oligonucleotide
tgctgatttgtgaacccattc

SEQ ID NO: 4290 - DNA, 21 bp, Artificial Sequence
  Description of Artificial Sequence: Synthetic oligonucleotide
  Description of Combined DNA/RNA Molecule: Synthetic oligonucleotide
ctgatttgtgaacccattcct

SEQ ID NO: 4291 - DNA, 21 bp, Artificial Sequence
  Description of Artificial Sequence: Synthetic oligonucleotide
  Description of Combined DNA/RNA Molecule: Synthetic oligonucleotide
gatttgtgaacccattcctca

SEQ ID NO: 4292 - DNA, 21 bp, Artificial Sequence
  Description of Artificial Sequence: Synthetic oligonucleotide
  Description of Combined DNA/RNA Molecule: Synthetic oligonucleotide
atcaaatattgaaattccttt

SEQ ID NO: 4293 - DNA, 21 bp, Artificial Sequence
  Description of Artificial Sequence: Synthetic oligonucleotide
  Description of Combined DNA/RNA Molecule: Synthetic oligonucleotide
caaatattgaaattcctttag

SEQ ID NO: 4294 - DNA, 21 bp, Artificial Sequence
  Description of Artificial Sequence: Synthetic oligonucleotide
  Description of Combined DNA/RNA Molecule: Synthetic oligonucleotide
aatattgaaattcctttagat

SEQ ID NO: 4295 - DNA, 21 bp, Artificial Sequence
  Description of Artificial Sequence: Synthetic oligonucleotide
  Description of Combined DNA/RNA Molecule: Synthetic oligonucleotide
tattgaaattcctttagatag

SEQ ID NO: 4296 - DNA, 21 bp, Artificial Sequence
  Description of Artificial Sequence: Synthetic oligonucleotide
  Description of Combined DNA/RNA Molecule: Synthetic oligonucleotide
ttgaaattcctttagatagca

SEQ ID NO: 4297 - DNA, 21 bp, Artificial Sequence
  Description of Artificial Sequence: Synthetic oligonucleotide
  Description of Combined DNA/RNA Molecule: Synthetic oligonucleotide
gaaattcctttagatagcaag

SEQ ID NO: 4298 - DNA, 21 bp, Artificial Sequence
  Description of Artificial Sequence: Synthetic oligonucleotide
  Description of Combined DNA/RNA Molecule: Synthetic oligonucleotide
aattcctttagatagcaagac

SEQ ID NO: 4299 - DNA, 21 bp, Artificial Sequence
  Description of Artificial Sequence: Synthetic oligonucleotide
  Description of Combined DNA/RNA Molecule: Synthetic oligonucleotide
cacagcctggatatgaaattt

SEQ ID NO: 4300 - DNA, 21 bp, Artificial Sequence
  Description of Artificial Sequence: Synthetic oligonucleotide
  Description of Combined DNA/RNA Molecule: Synthetic oligonucleotide
ggatatgaaattttcttattg

SEQ ID NO: 4301 - DNA, 21 bp, Artificial Sequence
  Description of Artificial Sequence: Synthetic oligonucleotide
  Description of Combined DNA/RNA Molecule: Synthetic oligonucleotide
aggccgctcaatttatgaata

SEQ ID NO: 4302 - DNA, 21 bp, Artificial Sequence
  Description of Artificial Sequence: Synthetic oligonucleotide
  Description of Combined DNA/RNA Molecule: Synthetic oligonucleotide
gccgctcaatttatgaatatt

SEQ ID NO: 4303 - DNA, 21 bp, Artificial Sequence
  Description of Artificial Sequence: Synthetic oligonucleotide
  Description of Combined DNA/RNA Molecule: Synthetic oligonucleotide
cgctcaatttatgaatattat

SEQ ID NO: 4304 - DNA, 21 bp, Artificial Sequence
  Description of Artificial Sequence: Synthetic oligonucleotide
  Description of Combined DNA/RNA Molecule: Synthetic oligonucleotide
ctcaatttatgaatattatca

SEQ ID NO: 4305 - DNA, 21 bp, Artificial Sequence
  Description of Artificial Sequence: Synthetic oligonucleotide
  Description of Combined DNA/RNA Molecule: Synthetic oligonucleotide
caatttatgaatattatcatg

SEQ ID NO: 4306 - DNA, 21 bp, Artificial Sequence
  Description of Artificial Sequence: Synthetic oligonucleotide
  Description of Combined DNA/RNA Molecule: Synthetic oligonucleotide
atttatgaatattatcatgct

SEQ ID NO: 4307 - DNA, 21 bp, Artificial Sequence
  Description of Artificial Sequence: Synthetic oligonucleotide
  Description of Combined DNA/RNA Molecule: Synthetic oligonucleotide
ttatgaatattatcatgcttt

SEQ ID NO: 4308 - DNA, 21 bp, Artificial Sequence
  Description of Artificial Sequence: Synthetic oligonucleotide
  Description of Combined DNA/RNA Molecule: Synthetic oligonucleotide
atgaatattatcatgctttgg

SEQ ID NO: 4309 - DNA, 21 bp, Artificial Sequence
  Description of Artificial Sequence: Synthetic oligonucleotide
  Description of Combined DNA/RNA Molecule: Synthetic oligonucleotide
tattatcatgctttggactct

SEQ ID NO: 4310 - DNA, 21 bp, Artificial Sequence
  Description of Artificial Sequence: Synthetic oligonucleotide
  Description of Combined DNA/RNA Molecule: Synthetic oligonucleotide
tatcatgctttggactctgat

SEQ ID NO: 4311 - DNA, 21 bp, Artificial Sequence
  Description of Artificial Sequence: Synthetic oligonucleotide
  Description of Combined DNA/RNA Molecule: Synthetic oligonucleotide
catgctttggactctgatcat

SEQ ID NO: 4312 - DNA, 21 bp, Artificial Sequence
  Description of Artificial Sequence: Synthetic oligonucleotide
  Description of Combined DNA/RNA Molecule: Synthetic oligonucleotide
gctttggactctgatcatctg

SEQ ID NO: 4313 - DNA, 21 bp, Artificial Sequence
  Description of Artificial Sequence: Synthetic oligonucleotide
  Description of Combined DNA/RNA Molecule: Synthetic oligonucleotide
actctgatcatctgaccaaaa

SEQ ID NO: 4314 - DNA, 21 bp, Artificial Sequence
  Description of Artificial Sequence: Synthetic oligonucleotide
  Description of Combined DNA/RNA Molecule: Synthetic oligonucleotide
tctgatcatctgaccaaaact

SEQ ID NO: 4315 - DNA, 21 bp, Artificial Sequence
  Description of Artificial Sequence: Synthetic oligonucleotide
  Description of Combined DNA/RNA Molecule: Synthetic oligonucleotide
tgatcatctgaccaaaactca

SEQ ID NO: 4316 - DNA, 21 bp, Artificial Sequence
  Description of Artificial Sequence: Synthetic oligonucleotide
  Description of Combined DNA/RNA Molecule: Synthetic oligonucleotide
tcatgatatgtttactaaagg

SEQ ID NO: 4317 - DNA, 21 bp, Artificial Sequence
  Description of Artificial Sequence: Synthetic oligonucleotide
  Description of Combined DNA/RNA Molecule: Synthetic oligonucleotide
atgatatgtttactaaaggac

SEQ ID NO: 4318 - DNA, 21 bp, Artificial Sequence
  Description of Artificial Sequence: Synthetic oligonucleotide
  Description of Combined DNA/RNA Molecule: Synthetic oligonucleotide
gatatgtttactaaaggacaa

SEQ ID NO: 4319 - DNA, 21 bp, Artificial Sequence
  Description of Artificial Sequence: Synthetic oligonucleotide
  Description of Combined DNA/RNA Molecule: Synthetic oligonucleotide
tatgtttactaaaggacaagt

SEQ ID NO: 4320 - DNA, 21 bp, Artificial Sequence
  Description of Artificial Sequence: Synthetic oligonucleotide
  Description of Combined DNA/RNA Molecule: Synthetic oligonucleotide
tgtttactaaaggacaagtca

SEQ ID NO: 4321 - DNA, 21 bp, Artificial Sequence
  Description of Artificial Sequence: Synthetic oligonucleotide
  Description of Combined DNA/RNA Molecule: Synthetic oligonucleotide
tttactaaaggacaagtcacc

SEQ ID NO: 4322 - DNA, 21 bp, Artificial Sequence
  Description of Artificial Sequence: Synthetic oligonucleotide
  Description of Combined DNA/RNA Molecule: Synthetic oligonucleotide
tactaaaggacaagtcaccac

SEQ ID NO: 4323 - DNA, 21 bp, Artificial Sequence
  Description of Artificial Sequence: Synthetic oligonucleotide
  Description of Combined DNA/RNA Molecule: Synthetic oligonucleotide
ctaaaggacaagtcaccacag

SEQ ID NO: 4324 - DNA, 21 bp, Artificial Sequence
  Description of Artificial Sequence: Synthetic oligonucleotide
  Description of Combined DNA/RNA Molecule: Synthetic oligonucleotide
aaaggacaagtcaccacagga

SEQ ID NO: 4325 - DNA, 21 bp, Artificial Sequence
  Description of Artificial Sequence: Synthetic oligonucleotide
  Description of Combined DNA/RNA Molecule: Synthetic oligonucleotide
aggacaagtcaccacaggaca

SEQ ID NO: 4326 - DNA, 21 bp, Artificial Sequence
  Description of Artificial Sequence: Synthetic oligonucleotide
  Description of Combined DNA/RNA Molecule: Synthetic oligonucleotide
gacaagtcaccacaggacagt

SEQ ID NO: 4327 - DNA, 21 bp, Artificial Sequence
  Description of Artificial Sequence: Synthetic oligonucleotide
  Description of Combined DNA/RNA Molecule: Synthetic oligonucleotide
caagtcaccacaggacagtac

SEQ ID NO: 4328 - DNA, 21 bp, Artificial Sequence
  Description of Artificial Sequence: Synthetic oligonucleotide
  Description of Combined DNA/RNA Molecule: Synthetic oligonucleotide
agtcaccacaggacagtacag

SEQ ID NO: 4329 - DNA, 21 bp, Artificial Sequence
  Description of Artificial Sequence: Synthetic oligonucleotide
  Description of Combined DNA/RNA Molecule: Synthetic oligonucleotide
tcaccacaggacagtacagga

SEQ ID NO: 4330 - DNA, 21 bp, Artificial Sequence
  Description of Artificial Sequence: Synthetic oligonucleotide
  Description of Combined DNA/RNA Molecule: Synthetic oligonucleotide
accacaggacagtacaggatg

SEQ ID NO: 4331 - DNA, 21 bp, Artificial Sequence
  Description of Artificial Sequence: Synthetic oligonucleotide
  Description of Combined DNA/RNA Molecule: Synthetic oligonucleotide
cacaggacagtacaggatgct

SEQ ID NO: 4332 - DNA, 21 bp, Artificial Sequence
  Description of Artificial Sequence: Synthetic oligonucleotide
  Description of Combined DNA/RNA Molecule: Synthetic oligonucleotide
caggacagtacaggatgcttg

SEQ ID NO: 4333 - DNA, 21 bp, Artificial Sequence
  Description of Artificial Sequence: Synthetic oligonucleotide
  Description of Combined DNA/RNA Molecule: Synthetic oligonucleotide
ggacagtacaggatgcttgcc

SEQ ID NO: 4334 - DNA, 21 bp, Artificial Sequence
  Description of Artificial Sequence: Synthetic oligonucleotide
  Description of Combined DNA/RNA Molecule: Synthetic oligonucleotide
acagtacaggatgcttgccaa

SEQ ID NO: 4335 - DNA, 21 bp, Artificial Sequence
  Description of Artificial Sequence: Synthetic oligonucleotide
  Description of Combined DNA/RNA Molecule: Synthetic oligonucleotide
agtacaggatgcttgccaaaa

SEQ ID NO: 4336 - DNA, 21 bp, Artificial Sequence
  Description of Artificial Sequence: Synthetic oligonucleotide
  Description of Combined DNA/RNA Molecule: Synthetic oligonucleotide
tacaggatgcttgccaaaaga

SEQ ID NO: 4337 - DNA, 21 bp, Artificial Sequence
  Description of Artificial Sequence: Synthetic oligonucleotide
  Description of Combined DNA/RNA Molecule: Synthetic oligonucleotide
caggatgcttgccaaaagagg

SEQ ID NO: 4338 - DNA, 21 bp, Artificial Sequence
  Description of Artificial Sequence: Synthetic oligonucleotide
  Description of Combined DNA/RNA Molecule: Synthetic oligonucleotide
ggatgcttgccaaaagaggtg

SEQ ID NO: 4339 - DNA, 21 bp, Artificial Sequence
  Description of Artificial Sequence: Synthetic oligonucleotide
  Description of Combined DNA/RNA Molecule: Synthetic oligonucleotide
atgcttgccaaaagaggtgga

SEQ ID NO: 4340 - DNA, 21 bp, Artificial Sequence
  Description of Artificial Sequence: Synthetic oligonucleotide
  Description of Combined DNA/RNA Molecule: Synthetic oligonucleotide
gcttgccaaaagaggtggata

SEQ ID NO: 4341 - DNA, 21 bp, Artificial Sequence
  Description of Artificial Sequence: Synthetic oligonucleotide
  Description of Combined DNA/RNA Molecule: Synthetic oligonucleotide
ttgccaaaagaggtggatatg

SEQ ID NO: 4342 - DNA, 21 bp, Artificial Sequence
  Description of Artificial Sequence: Synthetic oligonucleotide
  Description of Combined DNA/RNA Molecule: Synthetic oligonucleotide
gccaaaagaggtggatatgtc

SEQ ID NO: 4343 - DNA, 21 bp, Artificial Sequence
  Description of Artificial Sequence: Synthetic oligonucleotide
  Description of Combined DNA/RNA Molecule: Synthetic oligonucleotide
caaaagaggtggatatgtctg

SEQ ID NO: 4344 - DNA, 21 bp, Artificial Sequence
  Description of Artificial Sequence: Synthetic oligonucleotide
  Description of Combined DNA/RNA Molecule: Synthetic oligonucleotide
aaagaggtggatatgtctggg

SEQ ID NO: 4345 - DNA, 21 bp, Artificial Sequence
  Description of Artificial Sequence: Synthetic oligonucleotide
  Description of Combined DNA/RNA Molecule: Synthetic oligonucleotide
agaggtggatatgtctgggtt

SEQ ID NO: 4346 - DNA, 21 bp, Artificial Sequence
  Description of Artificial Sequence: Synthetic oligonucleotide
  Description of Combined DNA/RNA Molecule: Synthetic oligonucleotide
aggtggatatgtctgggttga

SEQ ID NO: 4347 - DNA, 21 bp, Artificial Sequence
  Description of Artificial Sequence: Synthetic oligonucleotide
  Description of Combined DNA/RNA Molecule: Synthetic oligonucleotide
gtggatatgtctgggttgaaa

SEQ ID NO: 4348 - DNA, 21 bp, Artificial Sequence
  Description of Artificial Sequence: Synthetic oligonucleotide
  Description of Combined DNA/RNA Molecule: Synthetic oligonucleotide
ggatatgtctgggttgaaact

SEQ ID NO: 4349 - DNA, 21 bp, Artificial Sequence
  Description of Artificial Sequence: Synthetic oligonucleotide
  Description of Combined DNA/RNA Molecule: Synthetic oligonucleotide
atatgtctgggttgaaactca

SEQ ID NO: 4350 - DNA, 21 bp, Artificial Sequence
  Description of Artificial Sequence: Synthetic oligonucleotide
  Description of Combined DNA/RNA Molecule: Synthetic oligonucleotide
atgtctgggttgaaactcaag

SEQ ID NO: 4351 - DNA, 21 bp, Artificial Sequence
  Description of Artificial Sequence: Synthetic oligonucleotide
  Description of Combined DNA/RNA Molecule: Synthetic oligonucleotide
gtctgggttgaaactcaagca

SEQ ID NO: 4352 - DNA, 21 bp, Artificial Sequence
  Description of Artificial Sequence: Synthetic oligonucleotide
  Description of Combined DNA/RNA Molecule: Synthetic oligonucleotide
ctgggttgaaactcaagcaac

SEQ ID NO: 4353 - DNA, 21 bp, Artificial Sequence
  Description of Artificial Sequence: Synthetic oligonucleotide
  Description of Combined DNA/RNA Molecule: Synthetic oligonucleotide
gggttgaaactcaagcaactg

SEQ ID NO: 4354 - DNA, 21 bp, Artificial Sequence
  Description of Artificial Sequence: Synthetic oligonucleotide
  Description of Combined DNA/RNA Molecule: Synthetic oligonucleotide
gttgaaactcaagcaactgtc

SEQ ID NO: 4355 - DNA, 21 bp, Artificial Sequence
  Description of Artificial Sequence: Synthetic oligonucleotide
  Description of Combined DNA/RNA Molecule: Synthetic oligonucleotide
tgaaactcaagcaactgtcat

SEQ ID NO: 4356 - DNA, 21 bp, Artificial Sequence
  Description of Artificial Sequence: Synthetic oligonucleotide
  Description of Combined DNA/RNA Molecule: Synthetic oligonucleotide
aaactcaagcaactgtcatat

SEQ ID NO: 4357 - DNA, 21 bp, Artificial Sequence
  Description of Artificial Sequence: Synthetic oligonucleotide
  Description of Combined DNA/RNA Molecule: Synthetic oligonucleotide
actcaagcaactgtcatatat

SEQ ID NO: 4358 - DNA, 21 bp, Artificial Sequence
  Description of Artificial Sequence: Synthetic oligonucleotide
  Description of Combined DNA/RNA Molecule: Synthetic oligonucleotide
tcaagcaactgtcatatataa

SEQ ID NO: 4359 - DNA, 21 bp, Artificial Sequence
  Description of Artificial Sequence: Synthetic oligonucleotide
  Description of Combined DNA/RNA Molecule: Synthetic oligonucleotide
gagtggtattattcagcacga

SEQ ID NO: 4360 - DNA, 21 bp, Artificial Sequence
  Description of Artificial Sequence: Synthetic oligonucleotide
  Description of Combined DNA/RNA Molecule: Synthetic oligonucleotide
gtggtattattcagcacgact

SEQ ID NO: 4361 - DNA, 21 bp, Artificial Sequence
  Description of Artificial Sequence: Synthetic oligonucleotide
  Description of Combined DNA/RNA Molecule: Synthetic oligonucleotide
ggtattattcagcacgacttg

SEQ ID NO: 4362 - DNA, 21 bp, Artificial Sequence
  Description of Artificial Sequence: Synthetic oligonucleotide
  Description of Combined DNA/RNA Molecule: Synthetic oligonucleotide
tattattcagcacgacttgat

SEQ ID NO: 4363 - DNA, 21 bp, Artificial Sequence
  Description of Artificial Sequence: Synthetic oligonucleotide
  Description of Combined DNA/RNA Molecule: Synthetic oligonucleotide
ttattcagcacgacttgattt

SEQ ID NO: 4364 - DNA, 21 bp, Artificial Sequence
  Description of Artificial Sequence: Synthetic oligonucleotide
  Description of Combined DNA/RNA Molecule: Synthetic oligonucleotide
attcagcacgacttgattttc

SEQ ID NO: 4365 - DNA, 21 bp, Artificial Sequence
  Description of Artificial Sequence: Synthetic oligonucleotide
  Description of Combined DNA/RNA Molecule: Synthetic oligonucleotide
tcagcacgacttgattttctc

SEQ ID NO: 4366 - DNA, 21 bp, Artificial Sequence
  Description of Artificial Sequence: Synthetic oligonucleotide
  Description of Combined DNA/RNA Molecule: Synthetic oligonucleotide
agcacgacttgattttctccc

SEQ ID NO: 4367 - DNA, 21 bp, Artificial Sequence
  Description of Artificial Sequence: Synthetic oligonucleotide
  Description of Combined DNA/RNA Molecule: Synthetic oligonucleotide
cacgacttgattttctccctt

SEQ ID NO: 4368 - DNA, 21 bp, Artificial Sequence
  Description of Artificial Sequence: Synthetic oligonucleotide
  Description of Combined DNA/RNA Molecule: Synthetic oligonucleotide
cgacttgattttctcccttca

SEQ ID NO: 4369 - DNA, 21 bp, Artificial Sequence
  Description of Artificial Sequence: Synthetic oligonucleotide
  Description of Combined DNA/RNA Molecule: Synthetic oligonucleotide
acttgattttctcccttcaac

SEQ ID NO: 4370 - DNA, 21 bp, Artificial Sequence
  Description of Artificial Sequence: Synthetic oligonucleotide
  Description of Combined DNA/RNA Molecule: Synthetic oligonucleotide
ttgattttctcccttcaacaa

SEQ ID NO: 4371 - DNA, 21 bp, Artificial Sequence
  Description of Artificial Sequence: Synthetic oligonucleotide
  Description of Combined DNA/RNA Molecule: Synthetic oligonucleotide
gattttctcccttcaacaaac

SEQ ID NO: 4372 - DNA, 21 bp, Artificial Sequence
  Description of Artificial Sequence: Synthetic oligonucleotide
  Description of Combined DNA/RNA Molecule: Synthetic oligonucleotide
ttttctcccttcaacaaacag

SEQ ID NO: 4373 - DNA, 21 bp, Artificial Sequence
  Description of Artificial Sequence: Synthetic oligonucleotide
  Description of Combined DNA/RNA Molecule: Synthetic oligonucleotide
ggttgaatcttcagatatgaa

SEQ ID NO: 4374 - DNA, 21 bp, Artificial Sequence
  Description of Artificial Sequence: Synthetic oligonucleotide
  Description of Combined DNA/RNA Molecule: Synthetic oligonucleotide
attcaccaaagttgaatcaga

SEQ ID NO: 4375 - DNA, 21 bp, Artificial Sequence
  Description of Artificial Sequence: Synthetic oligonucleotide
  Description of Combined DNA/RNA Molecule: Synthetic oligonucleotide
aagatacaagtagcctctttg

SEQ ID NO: 4376 - DNA, 21 bp, Artificial Sequence
  Description of Artificial Sequence: Synthetic oligonucleotide
  Description of Combined DNA/RNA Molecule: Synthetic oligonucleotide
cacaatcatatctttagattt

SEQ ID NO: 4377 - DNA, 21 bp, Artificial Sequence
  Description of Artificial Sequence: Synthetic oligonucleotide
  Description of Combined DNA/RNA Molecule: Synthetic oligonucleotide
gaagtaccattatataatgat

SEQ ID NO: 4378 - DNA, 21 bp, Artificial Sequence
  Description of Artificial Sequence: Synthetic oligonucleotide
  Description of Combined DNA/RNA Molecule: Synthetic oligonucleotide
accattatataatgatgtaat

SEQ ID NO: 4379 - DNA, 21 bp, Artificial Sequence
  Description of Artificial Sequence: Synthetic oligonucleotide
  Description of Combined DNA/RNA Molecule: Synthetic oligonucleotide
attacccaccgctgaaacgcc

SEQ ID NO: 4380 - DNA, 21 bp, Artificial Sequence
  Description of Artificial Sequence: Synthetic oligonucleotide
  Description of Combined DNA/RNA Molecule: Synthetic oligonucleotide
gccaaagccacttcgaagtag

SEQ ID NO: 4381 - DNA, 21 bp, Artificial Sequence
  Description of Artificial Sequence: Synthetic oligonucleotide
  Description of Combined DNA/RNA Molecule: Synthetic oligonucleotide
caaagccacttcgaagtagtg

SEQ ID NO: 4382 - DNA, 21 bp, Artificial Sequence
  Description of Artificial Sequence: Synthetic oligonucleotide
  Description of Combined DNA/RNA Molecule: Synthetic oligonucleotide
aagccacttcgaagtagtgct

SEQ ID NO: 4383 - DNA, 21 bp, Artificial Sequence
  Description of Artificial Sequence: Synthetic oligonucleotide
  Description of Combined DNA/RNA Molecule: Synthetic oligonucleotide
gccacttcgaagtagtgctga

SEQ ID NO: 4384 - DNA, 21 bp, Artificial Sequence
  Description of Artificial Sequence: Synthetic oligonucleotide
  Description of Combined DNA/RNA Molecule: Synthetic oligonucleotide
cttcgaagtagtgctgaccct

SEQ ID NO: 4385 - DNA, 21 bp, Artificial Sequence
  Description of Artificial Sequence: Synthetic oligonucleotide
  Description of Combined DNA/RNA Molecule: Synthetic oligonucleotide
aagaagttgcattaaaattag

SEQ ID NO: 4386 - DNA, 21 bp, Artificial Sequence
  Description of Artificial Sequence: Synthetic oligonucleotide
  Description of Combined DNA/RNA Molecule: Synthetic oligonucleotide
cgatggaagcactagacaaag

SEQ ID NO: 4387 - DNA, 21 bp, Artificial Sequence
  Description of Artificial Sequence: Synthetic oligonucleotide
  Description of Combined DNA/RNA Molecule: Synthetic oligonucleotide
atggaagcactagacaaagtt

SEQ ID NO: 4388 - DNA, 21 bp, Artificial Sequence
  Description of Artificial Sequence: Synthetic oligonucleotide
  Description of Combined DNA/RNA Molecule: Synthetic oligonucleotide
ggaagcactagacaaagttca

SEQ ID NO: 4389 - DNA, 21 bp, Artificial Sequence
  Description of Artificial Sequence: Synthetic oligonucleotide
  Description of Combined DNA/RNA Molecule: Synthetic oligonucleotide
aagcactagacaaagttcacc

SEQ ID NO: 4390 - DNA, 21 bp, Artificial Sequence
  Description of Artificial Sequence: Synthetic oligonucleotide
  Description of Combined DNA/RNA Molecule: Synthetic oligonucleotide
gcactagacaaagttcacctg

SEQ ID NO: 4391 - DNA, 21 bp, Artificial Sequence
  Description of Artificial Sequence: Synthetic oligonucleotide
  Description of Combined DNA/RNA Molecule: Synthetic oligonucleotide
actagacaaagttcacctgag

SEQ ID NO: 4392 - DNA, 21 bp, Artificial Sequence
  Description of Artificial Sequence: Synthetic oligonucleotide
  Description of Combined DNA/RNA Molecule: Synthetic oligonucleotide
ccagtgaatattgtttttatg

SEQ ID NO: 4393 - DNA, 21 bp, Artificial Sequence
  Description of Artificial Sequence: Synthetic oligonucleotide
  Description of Combined DNA/RNA Molecule: Synthetic oligonucleotide
tattgtttttatgtggatagt

SEQ ID NO: 4394 - DNA, 21 bp, Artificial Sequence
  Description of Artificial Sequence: Synthetic oligonucleotide
  Description of Combined DNA/RNA Molecule: Synthetic oligonucleotide
tggtagaaaaactttttgctg

SEQ ID NO: 4395 - DNA, 21 bp, Artificial Sequence
  Description of Artificial Sequence: Synthetic oligonucleotide
  Description of Combined DNA/RNA Molecule: Synthetic oligonucleotide
agctccctatatcccaatgga

SEQ ID NO: 4396 - DNA, 21 bp, Artificial Sequence
  Description of Artificial Sequence: Synthetic oligonucleotide
  Description of Combined DNA/RNA Molecule: Synthetic oligonucleotide
ctccctatatcccaatggatg

SEQ ID NO: 4397 - DNA, 21 bp, Artificial Sequence
  Description of Artificial Sequence: Synthetic oligonucleotide
  Description of Combined DNA/RNA Molecule: Synthetic oligonucleotide
ccctatatcccaatggatgat

SEQ ID NO: 4398 - DNA, 21 bp, Artificial Sequence
  Description of Artificial Sequence: Synthetic oligonucleotide
  Description of Combined DNA/RNA Molecule: Synthetic oligonucleotide
ctatatcccaatggatgatga

SEQ ID NO: 4399 - DNA, 21 bp, Artificial Sequence
  Description of Artificial Sequence: Synthetic oligonucleotide
  Description of Combined DNA/RNA Molecule: Synthetic oligonucleotide
cgatcagttgtcaccattaga

SEQ ID NO: 4400 - DNA, 21 bp, Artificial Sequence
  Description of Artificial Sequence: Synthetic oligonucleotide
  Description of Combined DNA/RNA Molecule: Synthetic oligonucleotide
cagttccgcaagccctgaaag

SEQ ID NO: 4401 - DNA, 21 bp, Artificial Sequence
  Description of Artificial Sequence: Synthetic oligonucleotide
  Description of Combined DNA/RNA Molecule: Synthetic oligonucleotide
gttccgcaagccctgaaagcg

SEQ ID NO: 4402 - DNA, 21 bp, Artificial Sequence
  Description of Artificial Sequence: Synthetic oligonucleotide
  Description of Combined DNA/RNA Molecule: Synthetic oligonucleotide
cactgatgaattaaaaacagt

SEQ ID NO: 4403 - DNA, 21 bp, Artificial Sequence
  Description of Artificial Sequence: Synthetic oligonucleotide
  Description of Combined DNA/RNA Molecule: Synthetic oligonucleotide
ggaagacattaaaatattgat

SEQ ID NO: 4404 - DNA, 21 bp, Artificial Sequence
  Description of Artificial Sequence: Synthetic oligonucleotide
  Description of Combined DNA/RNA Molecule: Synthetic oligonucleotide
aggagtcatagaacagacaga

SEQ ID NO: 4405 - DNA, 21 bp, Artificial Sequence
  Description of Artificial Sequence: Synthetic oligonucleotide
  Description of Combined DNA/RNA Molecule: Synthetic oligonucleotide
aagatactagctttgcagaat

SEQ ID NO: 4406 - DNA, 21 bp, Artificial Sequence
  Description of Artificial Sequence: Synthetic oligonucleotide
  Description of Combined DNA/RNA Molecule: Synthetic oligonucleotide
ctcagagaaagcgaaaaatgg

SEQ ID NO: 4407 - DNA, 21 bp, Artificial Sequence
  Description of Artificial Sequence: Synthetic oligonucleotide
  Description of Combined DNA/RNA Molecule: Synthetic oligonucleotide
aaagcgaaaaatggaacatga

SEQ ID NO: 4408 - DNA, 21 bp, Artificial Sequence
  Description of Artificial Sequence: Synthetic oligonucleotide
  Description of Combined DNA/RNA Molecule: Synthetic oligonucleotide
agcgaaaaatggaacatgatg

SEQ ID NO: 4409 - DNA, 21 bp, Artificial Sequence
  Description of Artificial Sequence: Synthetic oligonucleotide
  Description of Combined DNA/RNA Molecule: Synthetic oligonucleotide
caagcagtaggaattggaaca

SEQ ID NO: 4410 - DNA, 21 bp, Artificial Sequence
  Description of Artificial Sequence: Synthetic oligonucleotide
  Description of Combined DNA/RNA Molecule: Synthetic oligonucleotide
aaatctagtgaacagaatgga

SEQ ID NO: 4411 - DNA, 21 bp, Artificial Sequence
  Description of Artificial Sequence: Synthetic oligonucleotide
  Description of Combined DNA/RNA Molecule: Synthetic oligonucleotide
agcaaaagacaattattttaa

SEQ ID NO: 4412 - DNA, 21 bp, Artificial Sequence
  Description of Artificial Sequence: Synthetic oligonucleotide
  Description of Combined DNA/RNA Molecule: Synthetic oligonucleotide
aaagtggattaccacagctga

SEQ ID NO: 4413 - DNA, 21 bp, Artificial Sequence
  Description of Artificial Sequence: Synthetic oligonucleotide
  Description of Combined DNA/RNA Molecule: Synthetic oligonucleotide
agtggattaccacagctgacc

SEQ ID NO: 4414 - DNA, 21 bp, Artificial Sequence
  Description of Artificial Sequence: Synthetic oligonucleotide
  Description of Combined DNA/RNA Molecule: Synthetic oligonucleotide
tggattaccacagctgaccag

SEQ ID NO: 4415 - DNA, 21 bp, Artificial Sequence
  Description of Artificial Sequence: Synthetic oligonucleotide
  Description of Combined DNA/RNA Molecule: Synthetic oligonucleotide
gattaccacagctgaccagtt

SEQ ID NO: 4416 - DNA, 21 bp, Artificial Sequence
  Description of Artificial Sequence: Synthetic oligonucleotide
  Description of Combined DNA/RNA Molecule: Synthetic oligonucleotide
atgattgtgaagttaatgctc

SEQ ID NO: 4417 - DNA, 21 bp, Artificial Sequence
  Description of Artificial Sequence: Synthetic oligonucleotide
  Description of Combined DNA/RNA Molecule: Synthetic oligonucleotide
ctatacaaggcagcagaaacc

SEQ ID NO: 4418 - DNA, 21 bp, Artificial Sequence
  Description of Artificial Sequence: Synthetic oligonucleotide
  Description of Combined DNA/RNA Molecule: Synthetic oligonucleotide
atacaaggcagcagaaaccta

SEQ ID NO: 4419 - DNA, 21 bp, Artificial Sequence
  Description of Artificial Sequence: Synthetic oligonucleotide
  Description of Combined DNA/RNA Molecule: Synthetic oligonucleotide
acaaggcagcagaaacctact

SEQ ID NO: 4420 - DNA, 21 bp, Artificial Sequence
  Description of Artificial Sequence: Synthetic oligonucleotide
  Description of Combined DNA/RNA Molecule: Synthetic oligonucleotide
aaggcagcagaaacctactgc

SEQ ID NO: 4421 - DNA, 21 bp, Artificial Sequence
  Description of Artificial Sequence: Synthetic oligonucleotide
  Description of Combined DNA/RNA Molecule: Synthetic oligonucleotide
ggcagcagaaacctactgcag

SEQ ID NO: 4422 - DNA, 21 bp, Artificial Sequence
  Description of Artificial Sequence: Synthetic oligonucleotide
  Description of Combined DNA/RNA Molecule: Synthetic oligonucleotide
cagcagaaacctactgcaggg

SEQ ID NO: 4423 - DNA, 21 bp, Artificial Sequence
  Description of Artificial Sequence: Synthetic oligonucleotide
  Description of Combined DNA/RNA Molecule: Synthetic oligonucleotide
gcagaaacctactgcagggtg

SEQ ID NO: 4424 - DNA, 21 bp, Artificial Sequence
  Description of Artificial Sequence: Synthetic oligonucleotide
  Description of Combined DNA/RNA Molecule: Synthetic oligonucleotide
agaaacctactgcagggtgaa

SEQ ID NO: 4425 - DNA, 21 bp, Artificial Sequence
  Description of Artificial Sequence: Synthetic oligonucleotide
  Description of Combined DNA/RNA Molecule: Synthetic oligonucleotide
aaacctactgcagggtgaaga

SEQ ID NO: 4426 - DNA, 21 bp, Artificial Sequence
  Description of Artificial Sequence: Synthetic oligonucleotide
  Description of Combined DNA/RNA Molecule: Synthetic oligonucleotide
acctactgcagggtgaagaat

SEQ ID NO: 4427 - DNA, 21 bp, Artificial Sequence
  Description of Artificial Sequence: Synthetic oligonucleotide
  Description of Combined DNA/RNA Molecule: Synthetic oligonucleotide
ctactgcagggtgaagaatta

SEQ ID NO: 4428 - DNA, 21 bp, Artificial Sequence
  Description of Artificial Sequence: Synthetic oligonucleotide
  Description of Combined DNA/RNA Molecule: Synthetic oligonucleotide
actgcagggtgaagaattact

SEQ ID NO: 4429 - DNA, 21 bp, Artificial Sequence
  Description of Artificial Sequence: Synthetic oligonucleotide
  Description of Combined DNA/RNA Molecule: Synthetic oligonucleotide
tgcagggtgaagaattactca

SEQ ID NO: 4430 - DNA, 21 bp, Artificial Sequence
  Description of Artificial Sequence: Synthetic oligonucleotide
  Description of Combined DNA/RNA Molecule: Synthetic oligonucleotide
cagggtgaagaattactcaga

SEQ ID NO: 4431 - DNA, 21 bp, Artificial Sequence
  Description of Artificial Sequence: Synthetic oligonucleotide
  Description of Combined DNA/RNA Molecule: Synthetic oligonucleotide
gggtgaagaattactcagagc

SEQ ID NO: 4432 - DNA, 21 bp, Artificial Sequence
  Description of Artificial Sequence: Synthetic oligonucleotide
  Description of Combined DNA/RNA Molecule: Synthetic oligonucleotide
gtgaagaattactcagagctt

SEQ ID NO: 4433 - DNA, 21 bp, Artificial Sequence
  Description of Artificial Sequence: Synthetic oligonucleotide
  Description of Combined DNA/RNA Molecule: Synthetic oligonucleotide
gaagaattactcagagctttg

SEQ ID NO: 4434 - DNA, 21 bp, Artificial Sequence
  Description of Artificial Sequence: Synthetic oligonucleotide
  Description of Combined DNA/RNA Molecule: Synthetic oligonucleotide
agaattactcagagctttgga

SEQ ID NO: 4435 - DNA, 21 bp, Artificial Sequence
  Description of Artificial Sequence: Synthetic oligonucleotide
  Description of Combined DNA/RNA Molecule: Synthetic oligonucleotide
aattactcagagctttggatc

SEQ ID NO: 4436 - DNA, 21 bp, Artificial Sequence
  Description of Artificial Sequence: Synthetic oligonucleotide
  Description of Combined DNA/RNA Molecule: Synthetic oligonucleotide
ttactcagagctttggatcaa

SEQ ID NO: 4437 - DNA, 21 bp, Artificial Sequence
  Description of Artificial Sequence: Synthetic oligonucleotide
  Description of Combined DNA/RNA Molecule: Synthetic oligonucleotide
actcagagctttggatcaagt

SEQ ID NO: 4438 - DNA, 21 bp, Artificial Sequence
  Description of Artificial Sequence: Synthetic oligonucleotide
  Description of Combined DNA/RNA Molecule: Synthetic oligonucleotide
tcagagctttggatcaagtta

SEQ ID NO: 4439 - DNA, 21 bp, Artificial Sequence
  Description of Artificial Sequence: Synthetic oligonucleotide
  Description of Combined DNA/RNA Molecule: Synthetic oligonucleotide
agagctttggatcaagttaac

SEQ ID NO: 4440 - DNA, 21 bp, Artificial Sequence
  Description of Artificial Sequence: Synthetic oligonucleotide
  Description of Combined DNA/RNA Molecule: Synthetic oligonucleotide
agctttggatcaagttaactg

SEQ ID NO: 4441 - DNA, 21 bp, Artificial Sequence
  Description of Artificial Sequence: Synthetic oligonucleotide
  Description of Combined DNA/RNA Molecule: Synthetic oligonucleotide
ctttggatcaagttaactgag

SEQ ID NO: 4442 - DNA, 21 bp, Artificial Sequence
  Description of Artificial Sequence: Synthetic oligonucleotide
  Description of Combined DNA/RNA Molecule: Synthetic oligonucleotide
tggatcaagttaactgagctt

SEQ ID NO: 4443 - DNA, 21 bp, Artificial Sequence
  Description of Artificial Sequence: Synthetic oligonucleotide
  Description of Combined DNA/RNA Molecule: Synthetic oligonucleotide
aactgagctttttcttaattt

SEQ ID NO: 4444 - DNA, 21 bp, Artificial Sequence
  Description of Artificial Sequence: Synthetic oligonucleotide
  Description of Combined DNA/RNA Molecule: Synthetic oligonucleotide
gagctttttcttaatttcatt

SEQ ID NO: 4445 - DNA, 21 bp, Artificial Sequence
  Description of Artificial Sequence: Synthetic oligonucleotide
  Description of Combined DNA/RNA Molecule: Synthetic oligonucleotide
cttaatttcattccttttttt

SEQ ID NO: 4446 - DNA, 21 bp, Artificial Sequence
  Description of Artificial Sequence: Synthetic oligonucleotide
  Description of Combined DNA/RNA Molecule: Synthetic oligonucleotide
ttcattcctttttttggacac

SEQ ID NO: 4447 - DNA, 21 bp, Artificial Sequence
  Description of Artificial Sequence: Synthetic oligonucleotide
  Description of Combined DNA/RNA Molecule: Synthetic oligonucleotide
tttttttggacactggtggct

SEQ ID NO: 4448 - DNA, 21 bp, Artificial Sequence
  Description of Artificial Sequence: Synthetic oligonucleotide
  Description of Combined DNA/RNA Molecule: Synthetic oligonucleotide
tttttggacactggtggctca

SEQ ID NO: 4449 - DNA, 21 bp, Artificial Sequence
  Description of Artificial Sequence: Synthetic oligonucleotide
  Description of Combined DNA/RNA Molecule: Synthetic oligonucleotide
aagcagtctatttatattttc

SEQ ID NO: 4450 - DNA, 21 bp, Artificial Sequence
  Description of Artificial Sequence: Synthetic oligonucleotide
  Description of Combined DNA/RNA Molecule: Synthetic oligonucleotide
gcagtctatttatattttcta

SEQ ID NO: 4451 - DNA, 21 bp, Artificial Sequence
  Description of Artificial Sequence: Synthetic oligonucleotide
  Description of Combined DNA/RNA Molecule: Synthetic oligonucleotide
ctatttatattttctacatct

SEQ ID NO: 4452 - DNA, 21 bp, Artificial Sequence
  Description of Artificial Sequence: Synthetic oligonucleotide
  Description of Combined DNA/RNA Molecule: Synthetic oligonucleotide
catctaattttagaagcctgg

SEQ ID NO: 4453 - DNA, 21 bp, Artificial Sequence
  Description of Artificial Sequence: Synthetic oligonucleotide
  Description of Combined DNA/RNA Molecule: Synthetic oligonucleotide
tctaattttagaagcctggct

SEQ ID NO: 4454 - DNA, 21 bp, Artificial Sequence
  Description of Artificial Sequence: Synthetic oligonucleotide
  Description of Combined DNA/RNA Molecule: Synthetic oligonucleotide
taattttagaagcctggctac

SEQ ID NO: 4455 - DNA, 21 bp, Artificial Sequence
  Description of Artificial Sequence: Synthetic oligonucleotide
  Description of Combined DNA/RNA Molecule: Synthetic oligonucleotide
attttagaagcctggctacaa

SEQ ID NO: 4456 - DNA, 21 bp, Artificial Sequence
  Description of Artificial Sequence: Synthetic oligonucleotide
  Description of Combined DNA/RNA Molecule: Synthetic oligonucleotide
tttagaagcctggctacaata

SEQ ID NO: 4457 - DNA, 21 bp, Artificial Sequence
  Description of Artificial Sequence: Synthetic oligonucleotide
  Description of Combined DNA/RNA Molecule: Synthetic oligonucleotide
tagaagcctggctacaatact

SEQ ID NO: 4458 - DNA, 21 bp, Artificial Sequence
  Description of Artificial Sequence: Synthetic oligonucleotide
  Description of Combined DNA/RNA Molecule: Synthetic oligonucleotide
gaagcctggctacaatactgc

SEQ ID NO: 4459 - DNA, 21 bp, Artificial Sequence
  Description of Artificial Sequence: Synthetic oligonucleotide
  Description of Combined DNA/RNA Molecule: Synthetic oligonucleotide
agcctggctacaatactgcac

SEQ ID NO: 4460 - DNA, 21 bp, Artificial Sequence
  Description of Artificial Sequence: Synthetic oligonucleotide
  Description of Combined DNA/RNA Molecule: Synthetic oligonucleotide
cctggctacaatactgcacaa

SEQ ID NO: 4461 - DNA, 21 bp, Artificial Sequence
  Description of Artificial Sequence: Synthetic oligonucleotide
  Description of Combined DNA/RNA Molecule: Synthetic oligonucleotide
tggctacaatactgcacaaac

SEQ ID NO: 4462 - DNA, 21 bp, Artificial Sequence
  Description of Artificial Sequence: Synthetic oligonucleotide
  Description of Combined DNA/RNA Molecule: Synthetic oligonucleotide
cttaatttacattaatgctct

SEQ ID NO: 4463 - DNA, 21 bp, Artificial Sequence
  Description of Artificial Sequence: Synthetic oligonucleotide
  Description of Combined DNA/RNA Molecule: Synthetic oligonucleotide
attaatgctcttttttagtat

SEQ ID NO: 4464 - DNA, 21 bp, Artificial Sequence
  Description of Artificial Sequence: Synthetic oligonucleotide
  Description of Combined DNA/RNA Molecule: Synthetic oligonucleotide
taatgctcttttttagtatgt

SEQ ID NO: 4465 - DNA, 21 bp, Artificial Sequence
  Description of Artificial Sequence: Synthetic oligonucleotide
  Description of Combined DNA/RNA Molecule: Synthetic oligonucleotide
aatgctcttttttagtatgtt

SEQ ID NO: 4466 - DNA, 21 bp, Artificial Sequence
  Description of Artificial Sequence: Synthetic oligonucleotide
  Description of Combined DNA/RNA Molecule: Synthetic oligonucleotide
ttttagtatgttctttaatgc

SEQ ID NO: 4467 - DNA, 21 bp, Artificial Sequence
  Description of Artificial Sequence: Synthetic oligonucleotide
  Description of Combined DNA/RNA Molecule: Synthetic oligonucleotide
agtatgttctttaatgctgga

SEQ ID NO: 4468 - DNA, 21 bp, Artificial Sequence
  Description of Artificial Sequence: Synthetic oligonucleotide
  Description of Combined DNA/RNA Molecule: Synthetic oligonucleotide
tctttaatgctggatcacaga

SEQ ID NO: 4469 - DNA, 21 bp, Artificial Sequence
  Description of Artificial Sequence: Synthetic oligonucleotide
  Description of Combined DNA/RNA Molecule: Synthetic oligonucleotide
aatgctggatcacagacagct

SEQ ID NO: 4470 - DNA, 21 bp, Artificial Sequence
  Description of Artificial Sequence: Synthetic oligonucleotide
  Description of Combined DNA/RNA Molecule: Synthetic oligonucleotide
agctcattttctcagtttttt

SEQ ID NO: 4471 - DNA, 21 bp, Artificial Sequence
  Description of Artificial Sequence: Synthetic oligonucleotide
  Description of Combined DNA/RNA Molecule: Synthetic oligonucleotide
aaaaaatgcacctttttattt

SEQ ID NO: 4472 - DNA, 21 bp, Artificial Sequence
  Description of Artificial Sequence: Synthetic oligonucleotide
  Description of Combined DNA/RNA Molecule: Synthetic oligonucleotide
aaaatgcacctttttatttat

SEQ ID NO: 4473 - DNA, 21 bp, Artificial Sequence
  Description of Artificial Sequence: Synthetic oligonucleotide
  Description of Combined DNA/RNA Molecule: Synthetic oligonucleotide
aatgcacctttttatttattt

SEQ ID NO: 4474 - DNA, 21 bp, Artificial Sequence
  Description of Artificial Sequence: Synthetic oligonucleotide
  Description of Combined DNA/RNA Molecule: Synthetic oligonucleotide
tgcacctttttatttatttat

SEQ ID NO: 4475 - DNA, 21 bp, Artificial Sequence
  Description of Artificial Sequence: Synthetic oligonucleotide
  Description of Combined DNA/RNA Molecule: Synthetic oligonucleotide
cacctttttatttatttattt

SEQ ID NO: 4476 - DNA, 21 bp, Artificial Sequence
  Description of Artificial Sequence: Synthetic oligonucleotide
  Description of Combined DNA/RNA Molecule: Synthetic oligonucleotide
cctttttatttatttattttt

SEQ ID NO: 4477 - DNA, 21 bp, Artificial Sequence
  Description of Artificial Sequence: Synthetic oligonucleotide
  Description of Combined DNA/RNA Molecule: Synthetic oligonucleotide
tttttatttatttatttttgg

SEQ ID NO: 4478 - DNA, 21 bp, Artificial Sequence
  Description of Artificial Sequence: Synthetic oligonucleotide
  Description of Combined DNA/RNA Molecule: Synthetic oligonucleotide
ctttttcgaattatttttaag

SEQ ID NO: 4479 - DNA, 21 bp, Artificial Sequence
  Description of Artificial Sequence: Synthetic oligonucleotide
  Description of Combined DNA/RNA Molecule: Synthetic oligonucleotide
gccaatataatttttgtaaga

SEQ ID NO: 4480 - DNA, 21 bp, Artificial Sequence
  Description of Artificial Sequence: Synthetic oligonucleotide
  Description of Combined DNA/RNA Molecule: Synthetic oligonucleotide
ttcatcatgatcataggcagt

SEQ ID NO: 4481 - DNA, 21 bp, Artificial Sequence
  Description of Artificial Sequence: Synthetic oligonucleotide
  Description of Combined DNA/RNA Molecule: Synthetic oligonucleotide
catcatgatcataggcagttg

SEQ ID NO: 4482 - DNA, 21 bp, Artificial Sequence
  Description of Artificial Sequence: Synthetic oligonucleotide
  Description of Combined DNA/RNA Molecule: Synthetic oligonucleotide
tcatgatcataggcagttgaa

SEQ ID NO: 4483 - DNA, 21 bp, Artificial Sequence
  Description of Artificial Sequence: Synthetic oligonucleotide
  Description of Combined DNA/RNA Molecule: Synthetic oligonucleotide
atgatcataggcagttgaaaa

SEQ ID NO: 4484 - DNA, 21 bp, Artificial Sequence
  Description of Artificial Sequence: Synthetic oligonucleotide
  Description of Combined DNA/RNA Molecule: Synthetic oligonucleotide
agttgaaaaatttttacacct

SEQ ID NO: 4485 - DNA, 21 bp, Artificial Sequence
  Description of Artificial Sequence: Synthetic oligonucleotide
  Description of Combined DNA/RNA Molecule: Synthetic oligonucleotide
ccttttttttcacattttaca

SEQ ID NO: 4486 - DNA, 21 bp, Artificial Sequence
  Description of Artificial Sequence: Synthetic oligonucleotide
  Description of Combined DNA/RNA Molecule: Synthetic oligonucleotide
gtggtagccacaattgcacaa

SEQ ID NO: 4487 - DNA, 21 bp, Artificial Sequence
  Description of Artificial Sequence: Synthetic oligonucleotide
  Description of Combined DNA/RNA Molecule: Synthetic oligonucleotide
ggtagccacaattgcacaata

SEQ ID NO: 4488 - DNA, 21 bp, Artificial Sequence
  Description of Artificial Sequence: Synthetic oligonucleotide
  Description of Combined DNA/RNA Molecule: Synthetic oligonucleotide
tagccacaattgcacaatata

SEQ ID NO: 4489 - DNA, 21 bp, Artificial Sequence
  Description of Artificial Sequence: Synthetic oligonucleotide
  Description of Combined DNA/RNA Molecule: Synthetic oligonucleotide
gccacaattgcacaatatatt

SEQ ID NO: 4490 - DNA, 21 bp, Artificial Sequence
  Description of Artificial Sequence: Synthetic oligonucleotide
  Description of Combined DNA/RNA Molecule: Synthetic oligonucleotide
cacaattgcacaatatatttt

SEQ ID NO: 4491 - DNA, 21 bp, Artificial Sequence
  Description of Artificial Sequence: Synthetic oligonucleotide
  Description of Combined DNA/RNA Molecule: Synthetic oligonucleotide
caattgcacaatatattttct

SEQ ID NO: 4492 - DNA, 21 bp, Artificial Sequence
  Description of Artificial Sequence: Synthetic oligonucleotide
  Description of Combined DNA/RNA Molecule: Synthetic oligonucleotide
cacaatatattttcttaaaaa

SEQ ID NO: 4493 - DNA, 21 bp, Artificial Sequence
  Description of Artificial Sequence: Synthetic oligonucleotide
  Description of Combined DNA/RNA Molecule: Synthetic oligonucleotide
gcgtttataaaactagttttt

SEQ ID NO: 4494 - DNA, 21 bp, Artificial Sequence
  Description of Artificial Sequence: Synthetic oligonucleotide
  Description of Combined DNA/RNA Molecule: Synthetic oligonucleotide
cgtttataaaactagttttta

SEQ ID NO: 4495 - DNA, 21 bp, Artificial Sequence
  Description of Artificial Sequence: Synthetic oligonucleotide
  Description of Combined DNA/RNA Molecule: Synthetic oligonucleotide
tttataaaactagtttttaag

SEQ ID NO: 4496 - DNA, 21 bp, Artificial Sequence
  Description of Artificial Sequence: Synthetic oligonucleotide
  Description of Combined DNA/RNA Molecule: Synthetic oligonucleotide
tataaaactagtttttaagaa

SEQ ID NO: 4497 - DNA, 21 bp, Artificial Sequence
  Description of Artificial Sequence: Synthetic oligonucleotide
  Description of Combined DNA/RNA Molecule: Synthetic oligonucleotide
ttttaagaagaaatttttttt

SEQ ID NO: 4498 - DNA, 21 bp, Artificial Sequence
  Description of Artificial Sequence: Synthetic oligonucleotide
  Description of Combined DNA/RNA Molecule: Synthetic oligonucleotide
gaagaaattttttttggccta

SEQ ID NO: 4499 - DNA, 21 bp, Artificial Sequence
  Description of Artificial Sequence: Synthetic oligonucleotide
  Description of Combined DNA/RNA Molecule: Synthetic oligonucleotide
agaaattttttttggcctatg

SEQ ID NO: 4500 - DNA, 21 bp, Artificial Sequence
  Description of Artificial Sequence: Synthetic oligonucleotide
  Description of Combined DNA/RNA Molecule: Synthetic oligonucleotide
cctatgaaattgttaaacctg

SEQ ID NO: 4501 - DNA, 21 bp, Artificial Sequence
  Description of Artificial Sequence: Synthetic oligonucleotide
  Description of Combined DNA/RNA Molecule: Synthetic oligonucleotide
acattgttaatcatataataa

SEQ ID NO: 4502 - DNA, 21 bp, Artificial Sequence
  Description of Artificial Sequence: Synthetic oligonucleotide
  Description of Combined DNA/RNA Molecule: Synthetic oligonucleotide
gtatggtttattatttaaatg

SEQ ID NO: 4503 - DNA, 21 bp, Artificial Sequence
  Description of Artificial Sequence: Synthetic oligonucleotide
  Description of Combined DNA/RNA Molecule: Synthetic oligonucleotide
aatgggtaaagccatttacat

SEQ ID NO: 4504 - DNA, 21 bp, Artificial Sequence
  Description of Artificial Sequence: Synthetic oligonucleotide
  Description of Combined DNA/RNA Molecule: Synthetic oligonucleotide
ccatttacataatatagaaag

SEQ ID NO: 4505 - DNA, 21 bp, Artificial Sequence
  Description of Artificial Sequence: Synthetic oligonucleotide
  Description of Combined DNA/RNA Molecule: Synthetic oligonucleotide
agaaggtatgtggcatttatt

SEQ ID NO: 4506 - DNA, 21 bp, Artificial Sequence
  Description of Artificial Sequence: Synthetic oligonucleotide
  Description of Combined DNA/RNA Molecule: Synthetic oligonucleotide
aaggtatgtggcatttatttg

SEQ ID NO: 4507 - DNA, 21 bp, Artificial Sequence
  Description of Artificial Sequence: Synthetic oligonucleotide
  Description of Combined DNA/RNA Molecule: Synthetic oligonucleotide
ggtatgtggcatttatttgga

SEQ ID NO: 4508 - DNA, 21 bp, Artificial Sequence
  Description of Artificial Sequence: Synthetic oligonucleotide
  Description of Combined DNA/RNA Molecule: Synthetic oligonucleotide
tatgtggcatttatttggata

SEQ ID NO: 4509 - DNA, 21 bp, Artificial Sequence
  Description of Artificial Sequence: Synthetic oligonucleotide
  Description of Combined DNA/RNA Molecule: Synthetic oligonucleotide
tgtggcatttatttggataaa

SEQ ID NO: 4510 - DNA, 21 bp, Artificial Sequence
  Description of Artificial Sequence: Synthetic oligonucleotide
  Description of Combined DNA/RNA Molecule: Synthetic oligonucleotide
tggcatttatttggataaaat

SEQ ID NO: 4511 - DNA, 21 bp, Artificial Sequence
  Description of Artificial Sequence: Synthetic oligonucleotide
  Description of Combined DNA/RNA Molecule: Synthetic oligonucleotide
gcatttatttggataaaattc

SEQ ID NO: 4512 - DNA, 21 bp, Artificial Sequence
  Description of Artificial Sequence: Synthetic oligonucleotide
  Description of Combined DNA/RNA Molecule: Synthetic oligonucleotide
atttatttggataaaattctc

SEQ ID NO: 4513 - DNA, 21 bp, Artificial Sequence
  Description of Artificial Sequence: Synthetic oligonucleotide
  Description of Combined DNA/RNA Molecule: Synthetic oligonucleotide
ttatttggataaaattctcaa

SEQ ID NO: 4514 - DNA, 21 bp, Artificial Sequence
  Description of Artificial Sequence: Synthetic oligonucleotide
  Description of Combined DNA/RNA Molecule: Synthetic oligonucleotide
ttatttggataaaattctcaa

SEQ ID NO: 4515 - DNA, 21 bp, Artificial Sequence
  Description of Artificial Sequence: Synthetic oligonucleotide
  Description of Combined DNA/RNA Molecule: Synthetic oligonucleotide
atttggataaaattctcaatt

SEQ ID NO: 4516 - DNA, 21 bp, Artificial Sequence
  Description of Artificial Sequence: Synthetic oligonucleotide
  Description of Combined DNA/RNA Molecule: Synthetic oligonucleotide
ttggataaaattctcaattca

SEQ ID NO: 4517 - DNA, 21 bp, Artificial Sequence
  Description of Artificial Sequence: Synthetic oligonucleotide
  Description of Combined DNA/RNA Molecule: Synthetic oligonucleotide
ggataaaattctcaattcaga

SEQ ID NO: 4518 - DNA, 21 bp, Artificial Sequence
  Description of Artificial Sequence: Synthetic oligonucleotide
  Description of Combined DNA/RNA Molecule: Synthetic oligonucleotide
ataaaattctcaattcagaga

SEQ ID NO: 4519 - DNA, 21 bp, Artificial Sequence
  Description of Artificial Sequence: Synthetic oligonucleotide
  Description of Combined DNA/RNA Molecule: Synthetic oligonucleotide
catctgatgtttctatagtca

SEQ ID NO: 4520 - DNA, 21 bp, Artificial Sequence
  Description of Artificial Sequence: Synthetic oligonucleotide
  Description of Combined DNA/RNA Molecule: Synthetic oligonucleotide
atgtttctatagtcactttgc

SEQ ID NO: 4521 - DNA, 21 bp, Artificial Sequence
  Description of Artificial Sequence: Synthetic oligonucleotide
  Description of Combined DNA/RNA Molecule: Synthetic oligonucleotide
tctatagtcactttgccagct

SEQ ID NO: 4522 - DNA, 21 bp, Artificial Sequence
  Description of Artificial Sequence: Synthetic oligonucleotide
  Description of Combined DNA/RNA Molecule: Synthetic oligonucleotide
ctcaaaagaaaacaataccct

SEQ ID NO: 4523 - DNA, 21 bp, Artificial Sequence
  Description of Artificial Sequence: Synthetic oligonucleotide
  Description of Combined DNA/RNA Molecule: Synthetic oligonucleotide
tgttctgcctaccctgttggt

SEQ ID NO: 4524 - DNA, 21 bp, Artificial Sequence
  Description of Artificial Sequence: Synthetic oligonucleotide
  Description of Combined DNA/RNA Molecule: Synthetic oligonucleotide
ttctgcctaccctgttggtat

SEQ ID NO: 4525 - DNA, 21 bp, Artificial Sequence
  Description of Artificial Sequence: Synthetic oligonucleotide
  Description of Combined DNA/RNA Molecule: Synthetic oligonucleotide
tctgcctaccctgttggtata

SEQ ID NO: 4526 - DNA, 21 bp, Artificial Sequence
  Description of Artificial Sequence: Synthetic oligonucleotide
  Description of Combined DNA/RNA Molecule: Synthetic oligonucleotide
tgcctaccctgttggtataaa

SEQ ID NO: 4527 - DNA, 21 bp, Artificial Sequence
  Description of Artificial Sequence: Synthetic oligonucleotide
  Description of Combined DNA/RNA Molecule: Synthetic oligonucleotide
gcctaccctgttggtataaag

SEQ ID NO: 4528 - DNA, 21 bp, Artificial Sequence
  Description of Artificial Sequence: Synthetic oligonucleotide
  Description of Combined DNA/RNA Molecule: Synthetic oligonucleotide
ccctgttggtataaagatatt

SEQ ID NO: 4529 - DNA, 21 bp, Artificial Sequence
  Description of Artificial Sequence: Synthetic oligonucleotide
  Description of Combined DNA/RNA Molecule: Synthetic oligonucleotide
tgttggtataaagatattttg

SEQ ID NO: 4530 - DNA, 21 bp, Artificial Sequence
  Description of Artificial Sequence: Synthetic oligonucleotide
  Description of Combined DNA/RNA Molecule: Synthetic oligonucleotide
caagaaaaaaaaaatcatgca

SEQ ID NO: 4531 - DNA, 21 bp, Artificial Sequence
  Description of Artificial Sequence: Synthetic oligonucleotide
  Description of Combined DNA/RNA Molecule: Synthetic oligonucleotide
agtatgttaatttgctcaaaa

SEQ ID NO: 4532 - DNA, 21 bp, Artificial Sequence
  Description of Artificial Sequence: Synthetic oligonucleotide
  Description of Combined DNA/RNA Molecule: Synthetic oligonucleotide
gattttatgcactttgtcgct

SEQ ID NO: 4533 - DNA, 21 bp, Artificial Sequence
  Description of Artificial Sequence: Synthetic oligonucleotide
  Description of Combined DNA/RNA Molecule: Synthetic oligonucleotide
ttttatgcactttgtcgctat

SEQ ID NO: 4534 - DNA, 21 bp, Artificial Sequence
  Description of Artificial Sequence: Synthetic oligonucleotide
  Description of Combined DNA/RNA Molecule: Synthetic oligonucleotide
ttatgcactttgtcgctatta

SEQ ID NO: 4535 - DNA, 21 bp, Artificial Sequence
  Description of Artificial Sequence: Synthetic oligonucleotide
  Description of Combined DNA/RNA Molecule: Synthetic oligonucleotide
atgcactttgtcgctattaac

SEQ ID NO: 4536 - DNA, 21 bp, Artificial Sequence
  Description of Artificial Sequence: Synthetic oligonucleotide
  Description of Combined DNA/RNA Molecule: Synthetic oligonucleotide
gcactttgtcgctattaacat

SEQ ID NO: 4537 - DNA, 21 bp, Artificial Sequence
  Description of Artificial Sequence: Synthetic oligonucleotide
  Description of Combined DNA/RNA Molecule: Synthetic oligonucleotide
actttgtcgctattaacatcc

SEQ ID NO: 4538 - DNA, 21 bp, Artificial Sequence
  Description of Artificial Sequence: Synthetic oligonucleotide
  Description of Combined DNA/RNA Molecule: Synthetic oligonucleotide
tttgtcgctattaacatcctt

SEQ ID NO: 4539 - DNA, 21 bp, Artificial Sequence
  Description of Artificial Sequence: Synthetic oligonucleotide
  Description of Combined DNA/RNA Molecule: Synthetic oligonucleotide
tgtcgctattaacatcctttt

SEQ ID NO: 4540 - DNA, 21 bp, Artificial Sequence
  Description of Artificial Sequence: Synthetic oligonucleotide
  Description of Combined DNA/RNA Molecule: Synthetic oligonucleotide
tcgctattaacatcctttttt

SEQ ID NO: 4541 - DNA, 21 bp, Artificial Sequence
  Description of Artificial Sequence: Synthetic oligonucleotide
  Description of Combined DNA/RNA Molecule: Synthetic oligonucleotide
ctattaacatcctttttttca

SEQ ID NO: 4542 - DNA, 21 bp, Artificial Sequence
  Description of Artificial Sequence: Synthetic oligonucleotide
  Description of Combined DNA/RNA Molecule: Synthetic oligonucleotide
ttgagtaattttagaagcatt

SEQ ID NO: 4543 - DNA, 21 bp, Artificial Sequence
  Description of Artificial Sequence: Synthetic oligonucleotide
  Description of Combined DNA/RNA Molecule: Synthetic oligonucleotide
gagtaattttagaagcattat

SEQ ID NO: 4544 - DNA, 21 bp, Artificial Sequence
  Description of Artificial Sequence: Synthetic oligonucleotide
  Description of Combined DNA/RNA Molecule: Synthetic oligonucleotide
gtaattttagaagcattattt

SEQ ID NO: 4545 - DNA, 21 bp, Artificial Sequence
  Description of Artificial Sequence: Synthetic oligonucleotide
  Description of Combined DNA/RNA Molecule: Synthetic oligonucleotide
aattttagaagcattatttta

SEQ ID NO: 4546 - DNA, 21 bp, Artificial Sequence
  Description of Artificial Sequence: Synthetic oligonucleotide
  Description of Combined DNA/RNA Molecule: Synthetic oligonucleotide
ttttagaagcattattttagg

SEQ ID NO: 4547 - DNA, 21 bp, Artificial Sequence
  Description of Artificial Sequence: Synthetic oligonucleotide
  Description of Combined DNA/RNA Molecule: Synthetic oligonucleotide
ttagaagcattattttaggaa

SEQ ID NO: 4548 - DNA, 21 bp, Artificial Sequence
  Description of Artificial Sequence: Synthetic oligonucleotide
  Description of Combined DNA/RNA Molecule: Synthetic oligonucleotide
agaagcattattttaggaata

SEQ ID NO: 4549 - DNA, 21 bp, Artificial Sequence
  Description of Artificial Sequence: Synthetic oligonucleotide
  Description of Combined DNA/RNA Molecule: Synthetic oligonucleotide
aagcattattttaggaatata

SEQ ID NO: 4550 - DNA, 21 bp, Artificial Sequence
  Description of Artificial Sequence: Synthetic oligonucleotide
  Description of Combined DNA/RNA Molecule: Synthetic oligonucleotide
agtaaatatcttgttttttct

SEQ ID NO: 4551 - DNA, 21 bp, Artificial Sequence
  Description of Artificial Sequence: Synthetic oligonucleotide
  Description of Combined DNA/RNA Molecule: Synthetic oligonucleotide
ctatgtacattgtacaaattt

SEQ ID NO: 4552 - DNA, 21 bp, Artificial Sequence
  Description of Artificial Sequence: Synthetic oligonucleotide
  Description of Combined DNA/RNA Molecule: Synthetic oligonucleotide
ttttcattccttttgctcttt

SEQ ID NO: 4553 - DNA, 21 bp, Artificial Sequence
  Description of Artificial Sequence: Synthetic oligonucleotide
  Description of Combined DNA/RNA Molecule: Synthetic oligonucleotide
tttcattccttttgctctttg

SEQ ID NO: 4554 - DNA, 21 bp, Artificial Sequence
  Description of Artificial Sequence: Synthetic oligonucleotide
  Description of Combined DNA/RNA Molecule: Synthetic oligonucleotide
ttcattccttttgctctttgt

SEQ ID NO: 4555 - DNA, 21 bp, Artificial Sequence
  Description of Artificial Sequence: Synthetic oligonucleotide
  Description of Combined DNA/RNA Molecule: Synthetic oligonucleotide
cattccttttgctctttgtgg

SEQ ID NO: 4556 - DNA, 21 bp, Artificial Sequence
  Description of Artificial Sequence: Synthetic oligonucleotide
  Description of Combined DNA/RNA Molecule: Synthetic oligonucleotide
attccttttgctctttgtggt

SEQ ID NO: 4557 - DNA, 21 bp, Artificial Sequence
  Description of Artificial Sequence: Synthetic oligonucleotide
  Description of Combined DNA/RNA Molecule: Synthetic oligonucleotide
ttccttttgctctttgtggtt

SEQ ID NO: 4558 - DNA, 21 bp, Artificial Sequence
  Description of Artificial Sequence: Synthetic oligonucleotide
  Description of Combined DNA/RNA Molecule: Synthetic oligonucleotide
tccttttgctctttgtggttg

SEQ ID NO: 4559 - DNA, 21 bp, Artificial Sequence
  Description of Artificial Sequence: Synthetic oligonucleotide
  Description of Combined DNA/RNA Molecule: Synthetic oligonucleotide
ccttttgctctttgtggttgg

SEQ ID NO: 4560 - DNA, 21 bp, Artificial Sequence
  Description of Artificial Sequence: Synthetic oligonucleotide
  Description of Combined DNA/RNA Molecule: Synthetic oligonucleotide
cttttgctctttgtggttgga

SEQ ID NO: 4561 - DNA, 21 bp, Artificial Sequence
  Description of Artificial Sequence: Synthetic oligonucleotide
  Description of Combined DNA/RNA Molecule: Synthetic oligonucleotide
ttttgctctttgtggttggat

SEQ ID NO: 4562 - DNA, 21 bp, Artificial Sequence
  Description of Artificial Sequence: Synthetic oligonucleotide
  Description of Combined DNA/RNA Molecule: Synthetic oligonucleotide
tttgctctttgtggttggatc

SEQ ID NO: 4563 - DNA, 21 bp, Artificial Sequence
  Description of Artificial Sequence: Synthetic oligonucleotide
  Description of Combined DNA/RNA Molecule: Synthetic oligonucleotide
tgctctttgtggttggatcta

SEQ ID NO: 4564 - DNA, 21 bp, Artificial Sequence
  Description of Artificial Sequence: Synthetic oligonucleotide
  Description of Combined DNA/RNA Molecule: Synthetic oligonucleotide
acatcaaataaacatcttctg

SEQ ID NO: 4565 - DNA, 21 bp, Artificial Sequence
  Description of Artificial Sequence: Synthetic oligonucleotide
  Description of Combined DNA/RNA Molecule: Synthetic oligonucleotide
atcaaataaacatcttctgtg

SEQ ID NO: 4566 - DNA, 21 bp, Artificial Sequence
  Description of Artificial Sequence: Synthetic oligonucleotide
  Description of Combined DNA/RNA Molecule: Synthetic oligonucleotide
caaataaacatcttctgtgga

SEQ ID NO: 4567 - DNA, 21 bp, Artificial Sequence
  Description of Artificial Sequence: Synthetic oligonucleotide
  Description of Combined DNA/RNA Molecule: Synthetic oligonucleotide
aataaacatcttctgtggacc

SEQ ID NO: 4568 - DNA, 21 bp, Artificial Sequence
  Description of Artificial Sequence: Synthetic oligonucleotide
  Description of Combined DNA/RNA Molecule: Synthetic oligonucleotide
taaacatcttctgtggaccag

SEQ ID NO: 4569 - DNA, 21 bp, Artificial Sequence
  Description of Artificial Sequence: Synthetic oligonucleotide
  Description of Combined DNA/RNA Molecule: Synthetic oligonucleotide
aacatcttctgtggaccaggc

SEQ ID NO: 4570 - DNA, 21 bp, Artificial Sequence
  Description of Artificial Sequence: Synthetic oligonucleotide
  Description of Combined DNA/RNA Molecule: Synthetic oligonucleotide
gcccgcgggcgcgcgcgttgg

SEQ ID NO: 4571 - DNA, 21 bp, Artificial Sequence
  Description of Artificial Sequence: Synthetic oligonucleotide
  Description of Combined DNA/RNA Molecule: Synthetic oligonucleotide
ccgcgggcgcgcgcgttgggt

SEQ ID NO: 4572 - DNA, 21 bp, Artificial Sequence
  Description of Artificial Sequence: Synthetic oligonucleotide
  Description of Combined DNA/RNA Molecule: Synthetic oligonucleotide
cgcgggcgcgcgcgttgggtg

SEQ ID NO: 4573 - DNA, 21 bp, Artificial Sequence
  Description of Artificial Sequence: Synthetic oligonucleotide
  Description of Combined DNA/RNA Molecule: Synthetic oligonucleotide
gcgggcgcgcgcgttgggtgc

SEQ ID NO: 4574 - DNA, 21 bp, Artificial Sequence
  Description of Artificial Sequence: Synthetic oligonucleotide
  Description of Combined DNA/RNA Molecule: Synthetic oligonucleotide
cgggcgcgcgcgttgggtgct

SEQ ID NO: 4575 - DNA, 21 bp, Artificial Sequence
  Description of Artificial Sequence: Synthetic oligonucleotide
  Description of Combined DNA/RNA Molecule: Synthetic oligonucleotide
gggcgcgcgcgttgggtgctg

SEQ ID NO: 4576 - DNA, 21 bp, Artificial Sequence
  Description of Artificial Sequence: Synthetic oligonucleotide
  Description of Combined DNA/RNA Molecule: Synthetic oligonucleotide
ggcgcgcgcgttgggtgctga

SEQ ID NO: 4577 - DNA, 21 bp, Artificial Sequence
  Description of Artificial Sequence: Synthetic oligonucleotide
  Description of Combined DNA/RNA Molecule: Synthetic oligonucleotide
gcgcgcgcgttgggtgctgag

SEQ ID NO: 4578 - DNA, 21 bp, Artificial Sequence
  Description of Artificial Sequence: Synthetic oligonucleotide
  Description of Combined DNA/RNA Molecule: Synthetic oligonucleotide
cgcgcgcgttgggtgctgagc

SEQ ID NO: 4579 - DNA, 21 bp, Artificial Sequence
  Description of Artificial Sequence: Synthetic oligonucleotide
  Description of Combined DNA/RNA Molecule: Synthetic oligonucleotide
cgcgcgttgggtgctgagcgg

SEQ ID NO: 4580 - DNA, 21 bp, Artificial Sequence
  Description of Artificial Sequence: Synthetic oligonucleotide
  Description of Combined DNA/RNA Molecule: Synthetic oligonucleotide
gcgcgttgggtgctgagcggg

SEQ ID NO: 4581 - DNA, 21 bp, Artificial Sequence
  Description of Artificial Sequence: Synthetic oligonucleotide
  Description of Combined DNA/RNA Molecule: Synthetic oligonucleotide
cgcgttgggtgctgagcgggc

SEQ ID NO: 4582 - DNA, 21 bp, Artificial Sequence
  Description of Artificial Sequence: Synthetic oligonucleotide
  Description of Combined DNA/RNA Molecule: Synthetic oligonucleotide
gcgttgggtgctgagcgggcg

SEQ ID NO: 4583 - DNA, 21 bp, Artificial Sequence
  Description of Artificial Sequence: Synthetic oligonucleotide
  Description of Combined DNA/RNA Molecule: Synthetic oligonucleotide
cgttgggtgctgagcgggcgc

SEQ ID NO: 4584 - DNA, 21 bp, Artificial Sequence
  Description of Artificial Sequence: Synthetic oligonucleotide
  Description of Combined DNA/RNA Molecule: Synthetic oligonucleotide
ttgggtgctgagcgggcgcgc

SEQ ID NO: 4585 - DNA, 21 bp, Artificial Sequence
  Description of Artificial Sequence: Synthetic oligonucleotide
  Description of Combined DNA/RNA Molecule: Synthetic oligonucleotide
ccctcgccgcgcgcccgagcg

SEQ ID NO: 4586 - DNA, 21 bp, Artificial Sequence
  Description of Artificial Sequence: Synthetic oligonucleotide
  Description of Combined DNA/RNA Molecule: Synthetic oligonucleotide
cctcgccgcgcgcccgagcgc

SEQ ID NO: 4587 - DNA, 21 bp, Artificial Sequence
  Description of Artificial Sequence: Synthetic oligonucleotide
  Description of Combined DNA/RNA Molecule: Synthetic oligonucleotide
ctcgccgcgcgcccgagcgcg

SEQ ID NO: 4588 - DNA, 21 bp, Artificial Sequence
  Description of Artificial Sequence: Synthetic oligonucleotide
  Description of Combined DNA/RNA Molecule: Synthetic oligonucleotide
tcgccgcgcgcccgagcgcgc

SEQ ID NO: 4589 - DNA, 21 bp, Artificial Sequence
  Description of Artificial Sequence: Synthetic oligonucleotide
  Description of Combined DNA/RNA Molecule: Synthetic oligonucleotide
cctgccgctgcttcagcgcct

SEQ ID NO: 4590 - DNA, 21 bp, Artificial Sequence
  Description of Artificial Sequence: Synthetic oligonucleotide
  Description of Combined DNA/RNA Molecule: Synthetic oligonucleotide
tgccgctgcttcagcgcctca

SEQ ID NO: 4591 - DNA, 21 bp, Artificial Sequence
  Description of Artificial Sequence: Synthetic oligonucleotide
  Description of Combined DNA/RNA Molecule: Synthetic oligonucleotide
gctgcttcagcgcctcagtgc

SEQ ID NO: 4592 - DNA, 21 bp, Artificial Sequence
  Description of Artificial Sequence: Synthetic oligonucleotide
  Description of Combined DNA/RNA Molecule: Synthetic oligonucleotide
ctgcttcagcgcctcagtgca

SEQ ID NO: 4593 - DNA, 21 bp, Artificial Sequence
  Description of Artificial Sequence: Synthetic oligonucleotide
  Description of Combined DNA/RNA Molecule: Synthetic oligonucleotide
gcttcagcgcctcagtgcaca

SEQ ID NO: 4594 - DNA, 21 bp, Artificial Sequence
  Description of Artificial Sequence: Synthetic oligonucleotide
  Description of Combined DNA/RNA Molecule: Synthetic oligonucleotide
cagcgcctcagtgcacagagc

SEQ ID NO: 4595 - DNA, 21 bp, Artificial Sequence
  Description of Artificial Sequence: Synthetic oligonucleotide
  Description of Combined DNA/RNA Molecule: Synthetic oligonucleotide
gagccggagctcagcgagcgc

SEQ ID NO: 4596 - DNA, 21 bp, Artificial Sequence
  Description of Artificial Sequence: Synthetic oligonucleotide
  Description of Combined DNA/RNA Molecule: Synthetic oligonucleotide
gagctcagcgagcgcagcctg

SEQ ID NO: 4597 - DNA, 21 bp, Artificial Sequence
  Description of Artificial Sequence: Synthetic oligonucleotide
  Description of Combined DNA/RNA Molecule: Synthetic oligonucleotide
cagcgagcgcagcctgcagct

SEQ ID NO: 4598 - DNA, 21 bp, Artificial Sequence
  Description of Artificial Sequence: Synthetic oligonucleotide
  Description of Combined DNA/RNA Molecule: Synthetic oligonucleotide
agcgagcgcagcctgcagctc

SEQ ID NO: 4599 - DNA, 21 bp, Artificial Sequence
  Description of Artificial Sequence: Synthetic oligonucleotide
  Description of Combined DNA/RNA Molecule: Synthetic oligonucleotide
gcgagcgcagcctgcagctcc

SEQ ID NO: 4600 - DNA, 21 bp, Artificial Sequence
  Description of Artificial Sequence: Synthetic oligonucleotide
  Description of Combined DNA/RNA Molecule: Synthetic oligonucleotide
gagcgcagcctgcagctcccg

SEQ ID NO: 4601 - DNA, 21 bp, Artificial Sequence
  Description of Artificial Sequence: Synthetic oligonucleotide
  Description of Combined DNA/RNA Molecule: Synthetic oligonucleotide
cgcagcctgcagctcccgcct

SEQ ID NO: 4602 - DNA, 21 bp, Artificial Sequence
  Description of Artificial Sequence: Synthetic oligonucleotide
  Description of Combined DNA/RNA Molecule: Synthetic oligonucleotide
tggacttgtctctttctccgc

SEQ ID NO: 4603 - DNA, 21 bp, Artificial Sequence
  Description of Artificial Sequence: Synthetic oligonucleotide
  Description of Combined DNA/RNA Molecule: Synthetic oligonucleotide
gacttgtctctttctccgcgc

SEQ ID NO: 4604 - DNA, 21 bp, Artificial Sequence
  Description of Artificial Sequence: Synthetic oligonucleotide
  Description of Combined DNA/RNA Molecule: Synthetic oligonucleotide
cttgtctctttctccgcgcgc

SEQ ID NO: 4605 - DNA, 21 bp, Artificial Sequence
  Description of Artificial Sequence: Synthetic oligonucleotide
  Description of Combined DNA/RNA Molecule: Synthetic oligonucleotide
ttgtctctttctccgcgcgcg

SEQ ID NO: 4606 - DNA, 21 bp, Artificial Sequence
  Description of Artificial Sequence: Synthetic oligonucleotide
  Description of Combined DNA/RNA Molecule: Synthetic oligonucleotide
tgtctctttctccgcgcgcgc

SEQ ID NO: 4607 - DNA, 21 bp, Artificial Sequence
  Description of Artificial Sequence: Synthetic oligonucleotide
  Description of Combined DNA/RNA Molecule: Synthetic oligonucleotide
ctctttctccgcgcgcgcgga

SEQ ID NO: 4608 - DNA, 21 bp, Artificial Sequence
  Description of Artificial Sequence: Synthetic oligonucleotide
  Description of Combined DNA/RNA Molecule: Synthetic oligonucleotide
ctttctccgcgcgcgcggaca

SEQ ID NO: 4609 - DNA, 21 bp, Artificial Sequence
  Description of Artificial Sequence: Synthetic oligonucleotide
  Description of Combined DNA/RNA Molecule: Synthetic oligonucleotide
ccgcgcgcgcggacagagccg

SEQ ID NO: 4610 - DNA, 21 bp, Artificial Sequence
  Description of Artificial Sequence: Synthetic oligonucleotide
  Description of Combined DNA/RNA Molecule: Synthetic oligonucleotide
gtgagctcacatcttgataaa

SEQ ID NO: 4611 - DNA, 21 bp, Artificial Sequence
  Description of Artificial Sequence: Synthetic oligonucleotide
  Description of Combined DNA/RNA Molecule: Synthetic oligonucleotide
agctcacatcttgataaagct

SEQ ID NO: 4612 - DNA, 21 bp, Artificial Sequence
  Description of Artificial Sequence: Synthetic oligonucleotide
  Description of Combined DNA/RNA Molecule: Synthetic oligonucleotide
tggactgtttttatctgaaag

SEQ ID NO: 4613 - DNA, 21 bp, Artificial Sequence
  Description of Artificial Sequence: Synthetic oligonucleotide
  Description of Combined DNA/RNA Molecule: Synthetic oligonucleotide
cacccatgacgtgcttggtgc

SEQ ID NO: 4614 - DNA, 21 bp, Artificial Sequence
  Description of Artificial Sequence: Synthetic oligonucleotide
  Description of Combined DNA/RNA Molecule: Synthetic oligonucleotide
gatacaagctgcctttttgat

SEQ ID NO: 4615 - DNA, 21 bp, Artificial Sequence
  Description of Artificial Sequence: Synthetic oligonucleotide
  Description of Combined DNA/RNA Molecule: Synthetic oligonucleotide
tacaagctgcctttttgataa

SEQ ID NO: 4616 - DNA, 21 bp, Artificial Sequence
  Description of Artificial Sequence: Synthetic oligonucleotide
  Description of Combined DNA/RNA Molecule: Synthetic oligonucleotide
acaagctgcctttttgataag

SEQ ID NO: 4617 - DNA, 21 bp, Artificial Sequence
  Description of Artificial Sequence: Synthetic oligonucleotide
  Description of Combined DNA/RNA Molecule: Synthetic oligonucleotide
agctgcctttttgataagctt

SEQ ID NO: 4618 - DNA, 21 bp, Artificial Sequence
  Description of Artificial Sequence: Synthetic oligonucleotide
  Description of Combined DNA/RNA Molecule: Synthetic oligonucleotide
gatgctctcactctgctggct

SEQ ID NO: 4619 - DNA, 21 bp, Artificial Sequence
  Description of Artificial Sequence: Synthetic oligonucleotide
  Description of Combined DNA/RNA Molecule: Synthetic oligonucleotide
atgctctcactctgctggctc

SEQ ID NO: 4620 - DNA, 21 bp, Artificial Sequence
  Description of Artificial Sequence: Synthetic oligonucleotide
  Description of Combined DNA/RNA Molecule: Synthetic oligonucleotide
tgctctcactctgctggctcc

SEQ ID NO: 4621 - DNA, 21 bp, Artificial Sequence
  Description of Artificial Sequence: Synthetic oligonucleotide
  Description of Combined DNA/RNA Molecule: Synthetic oligonucleotide
ctctgctggctccagctgccg

SEQ ID NO: 4622 - DNA, 21 bp, Artificial Sequence
  Description of Artificial Sequence: Synthetic oligonucleotide
  Description of Combined DNA/RNA Molecule: Synthetic oligonucleotide
cttcgaagtagtgctgatcct

SEQ ID NO: 4623 - DNA, 21 bp, Artificial Sequence
  Description of Artificial Sequence: Synthetic oligonucleotide
  Description of Combined DNA/RNA Molecule: Synthetic oligonucleotide
aatattgctttgatgtggata

SEQ ID NO: 4624 - DNA, 21 bp, Artificial Sequence
  Description of Artificial Sequence: Synthetic oligonucleotide
  Description of Combined DNA/RNA Molecule: Synthetic oligonucleotide
tattgctttgatgtggatagc

SEQ ID NO: 4625 - DNA, 21 bp, Artificial Sequence
  Description of Artificial Sequence: Synthetic oligonucleotide
  Description of Combined DNA/RNA Molecule: Synthetic oligonucleotide
ttgctttgatgtggatagcga

SEQ ID NO: 4626 - DNA, 21 bp, Artificial Sequence
  Description of Artificial Sequence: Synthetic oligonucleotide
  Description of Combined DNA/RNA Molecule: Synthetic oligonucleotide
atgatggctccctttttcaag

SEQ ID NO: 4627 - DNA, 21 bp, Artificial Sequence
  Description of Artificial Sequence: Synthetic oligonucleotide
  Description of Combined DNA/RNA Molecule: Synthetic oligonucleotide
gtttctgttggttatttttgg

SEQ ID NO: 4628 - DNA, 21 bp, Artificial Sequence
  Description of Artificial Sequence: Synthetic oligonucleotide
  Description of Combined DNA/RNA Molecule: Synthetic oligonucleotide
tgttaagcctggatcatgaag

SEQ ID NO: 4629 - DNA, 21 bp, Artificial Sequence
  Description of Artificial Sequence: Synthetic oligonucleotide
  Description of Combined DNA/RNA Molecule: Synthetic oligonucleotide
agcctggatcatgaagctgtt

SEQ ID NO: 4630 - DNA, 21 bp, Artificial Sequence
  Description of Artificial Sequence: Synthetic oligonucleotide
  Description of Combined DNA/RNA Molecule: Synthetic oligonucleotide
agctgttgatcttataatgat

SEQ ID NO: 4631 - DNA, 21 bp, Artificial Sequence
  Description of Artificial Sequence: Synthetic oligonucleotide
  Description of Combined DNA/RNA Molecule: Synthetic oligonucleotide
atgattcttaaactgtatggt

SEQ ID NO: 4632 - DNA, 21 bp, Artificial Sequence
  Description of Artificial Sequence: Synthetic oligonucleotide
  Description of Combined DNA/RNA Molecule: Synthetic oligonucleotide
ctgtatggtttctttatatgg

SEQ ID NO: 4633 - DNA, 21 bp, Artificial Sequence
  Description of Artificial Sequence: Synthetic oligonucleotide
  Description of Combined DNA/RNA Molecule: Synthetic oligonucleotide
catagtaaacatcttgttttt

SEQ ID NO: 4634 - DNA, 21 bp, Artificial Sequence
  Description of Artificial Sequence: Synthetic oligonucleotide
  Description of Combined DNA/RNA Molecule: Synthetic oligonucleotide
ttttcgttcccttgctctttg

SEQ ID NO: 4635 - DNA, 21 bp, Artificial Sequence
  Description of Artificial Sequence: Synthetic oligonucleotide
  Description of Combined DNA/RNA Molecule: Synthetic oligonucleotide
tttcgttcccttgctctttgt

SEQ ID NO: 4636 - DNA, 21 bp, Artificial Sequence
  Description of Artificial Sequence: Synthetic oligonucleotide
  Description of Combined DNA/RNA Molecule: Synthetic oligonucleotide
ttcccttgctctttgtggttg

SEQ ID NO: 4637 - DNA, 21 bp, Artificial Sequence
  Description of Artificial Sequence: Synthetic oligonucleotide
  Description of Combined DNA/RNA Molecule: Synthetic oligonucleotide
tttccgcgctctcagggagct

SEQ ID NO: 4638 - DNA, 21 bp, Artificial Sequence
  Description of Artificial Sequence: Synthetic oligonucleotide
  Description of Combined DNA/RNA Molecule: Synthetic oligonucleotide
acctgatgtttctttactttg

SEQ ID NO: 4639 - DNA, 21 bp, Artificial Sequence
  Description of Artificial Sequence: Synthetic oligonucleotide
  Description of Combined DNA/RNA Molecule: Synthetic oligonucleotide
cctgatgtttctttactttgc

SEQ ID NO: 4640 - DNA, 21 bp, Artificial Sequence
  Description of Artificial Sequence: Synthetic oligonucleotide
  Description of Combined DNA/RNA Molecule: Synthetic oligonucleotide
ctgatgtttctttactttgcc

SEQ ID NO: 4641 - DNA, 21 bp, Artificial Sequence
  Description of Artificial Sequence: Synthetic oligonucleotide
  Description of Combined DNA/RNA Molecule: Synthetic oligonucleotide
ttgccagctttaaaaaagtat

SEQ ID NO: 4642 - DNA, 21 bp, Artificial Sequence
  Description of Artificial Sequence: Synthetic oligonucleotide
  Description of Combined DNA/RNA Molecule: Synthetic oligonucleotide
aaagataagttctgaacgtcg

SEQ ID NO: 4643 - DNA, 21 bp, Artificial Sequence
  Description of Artificial Sequence: Synthetic oligonucleotide
  Description of Combined DNA/RNA Molecule: Synthetic oligonucleotide
gataagttctgaacgtcgaaa

SEQ ID NO: 4644 - DNA, 21 bp, Artificial Sequence
  Description of Artificial Sequence: Synthetic oligonucleotide
  Description of Combined DNA/RNA Molecule: Synthetic oligonucleotide
taagttctgaacgtcgaaaag

SEQ ID NO: 4645 - DNA, 21 bp, Artificial Sequence
  Description of Artificial Sequence: Synthetic oligonucleotide
  Description of Combined DNA/RNA Molecule: Synthetic oligonucleotide
ttctgaacgtcgaaaagaaaa

SEQ ID NO: 4646 - DNA, 21 bp, Artificial Sequence
  Description of Artificial Sequence: Synthetic oligonucleotide
  Description of Combined DNA/RNA Molecule: Synthetic oligonucleotide
gtcgaaaagaaaagtctcgag

SEQ ID NO: 4647 - DNA, 21 bp, Artificial Sequence
  Description of Artificial Sequence: Synthetic oligonucleotide
  Description of Combined DNA/RNA Molecule: Synthetic oligonucleotide
tcgaaaagaaaagtctcgaga

SEQ ID NO: 4648 - DNA, 21 bp, Artificial Sequence
  Description of Artificial Sequence: Synthetic oligonucleotide
  Description of Combined DNA/RNA Molecule: Synthetic oligonucleotide
ggcgaagtaaagaatctgaag

SEQ ID NO: 4649 - DNA, 21 bp, Artificial Sequence
  Description of Artificial Sequence: Synthetic oligonucleotide
  Description of Combined DNA/RNA Molecule: Synthetic oligonucleotide
gcgaagtaaagaatctgaagt

SEQ ID NO: 4650 - DNA, 21 bp, Artificial Sequence
  Description of Artificial Sequence: Synthetic oligonucleotide
  Description of Combined DNA/RNA Molecule: Synthetic oligonucleotide
gaagtaaagaatctgaagttt

SEQ ID NO: 4651 - DNA, 21 bp, Artificial Sequence
  Description of Artificial Sequence: Synthetic oligonucleotide
  Description of Combined DNA/RNA Molecule: Synthetic oligonucleotide
aagtaaagaatctgaagtttt

SEQ ID NO: 4652 - DNA, 21 bp, Artificial Sequence
  Description of Artificial Sequence: Synthetic oligonucleotide
  Description of Combined DNA/RNA Molecule: Synthetic oligonucleotide
gtaaagaatctgaagtttttt

SEQ ID NO: 4653 - DNA, 21 bp, Artificial Sequence
  Description of Artificial Sequence: Synthetic oligonucleotide
  Description of Combined DNA/RNA Molecule: Synthetic oligonucleotide
atctgaagttttttatgagct

SEQ ID NO: 4654 - DNA, 21 bp, Artificial Sequence
  Description of Artificial Sequence: Synthetic oligonucleotide
  Description of Combined DNA/RNA Molecule: Synthetic oligonucleotide
cagttgccacttccacataat

SEQ ID NO: 4655 - DNA, 21 bp, Artificial Sequence
  Description of Artificial Sequence: Synthetic oligonucleotide
  Description of Combined DNA/RNA Molecule: Synthetic oligonucleotide
atgtgagttcgcatcttgata

SEQ ID NO: 4656 - DNA, 21 bp, Artificial Sequence
  Description of Artificial Sequence: Synthetic oligonucleotide
  Description of Combined DNA/RNA Molecule: Synthetic oligonucleotide
atgaggcttaccatcagctat

SEQ ID NO: 4657 - DNA, 21 bp, Artificial Sequence
  Description of Artificial Sequence: Synthetic oligonucleotide
  Description of Combined DNA/RNA Molecule: Synthetic oligonucleotide
tgaggaaacttctggatgctg

SEQ ID NO: 4658 - DNA, 21 bp, Artificial Sequence
  Description of Artificial Sequence: Synthetic oligonucleotide
  Description of Combined DNA/RNA Molecule: Synthetic oligonucleotide
tgctggtgatttggatattga

SEQ ID NO: 4659 - DNA, 21 bp, Artificial Sequence
  Description of Artificial Sequence: Synthetic oligonucleotide
  Description of Combined DNA/RNA Molecule: Synthetic oligonucleotide
ctggtgatttggatattgaag

SEQ ID NO: 4660 - DNA, 21 bp, Artificial Sequence
  Description of Artificial Sequence: Synthetic oligonucleotide
  Description of Combined DNA/RNA Molecule: Synthetic oligonucleotide
atttggatattgaagatgaca

SEQ ID NO: 4661 - DNA, 21 bp, Artificial Sequence
  Description of Artificial Sequence: Synthetic oligonucleotide
  Description of Combined DNA/RNA Molecule: Synthetic oligonucleotide
tttggatattgaagatgacat

SEQ ID NO: 4662 - DNA, 21 bp, Artificial Sequence
  Description of Artificial Sequence: Synthetic oligonucleotide
  Description of Combined DNA/RNA Molecule: Synthetic oligonucleotide
tggatattgaagatgacatga

SEQ ID NO: 4663 - DNA, 21 bp, Artificial Sequence
  Description of Artificial Sequence: Synthetic oligonucleotide
  Description of Combined DNA/RNA Molecule: Synthetic oligonucleotide
ggatattgaagatgacatgaa

SEQ ID NO: 4664 - DNA, 21 bp, Artificial Sequence
  Description of Artificial Sequence: Synthetic oligonucleotide
  Description of Combined DNA/RNA Molecule: Synthetic oligonucleotide
gaagatgacatgaaagcacag

SEQ ID NO: 4665 - DNA, 21 bp, Artificial Sequence
  Description of Artificial Sequence: Synthetic oligonucleotide
  Description of Combined DNA/RNA Molecule: Synthetic oligonucleotide
aagatgacatgaaagcacaga

SEQ ID NO: 4666 - DNA, 21 bp, Artificial Sequence
  Description of Artificial Sequence: Synthetic oligonucleotide
  Description of Combined DNA/RNA Molecule: Synthetic oligonucleotide
tgaaagcacagatgaattgct

SEQ ID NO: 4667 - DNA, 21 bp, Artificial Sequence
  Description of Artificial Sequence: Synthetic oligonucleotide
  Description of Combined DNA/RNA Molecule: Synthetic oligonucleotide
cacagatgaattgcttttatt

SEQ ID NO: 4668 - DNA, 21 bp, Artificial Sequence
  Description of Artificial Sequence: Synthetic oligonucleotide
  Description of Combined DNA/RNA Molecule: Synthetic oligonucleotide
acagatgaattgcttttattt

SEQ ID NO: 4669 - DNA, 21 bp, Artificial Sequence
  Description of Artificial Sequence: Synthetic oligonucleotide
  Description of Combined DNA/RNA Molecule: Synthetic oligonucleotide
ttttatttgaaagccttggat

SEQ ID NO: 4670 - DNA, 21 bp, Artificial Sequence
  Description of Artificial Sequence: Synthetic oligonucleotide
  Description of Combined DNA/RNA Molecule: Synthetic oligonucleotide
tttatttgaaagccttggatg

SEQ ID NO: 4671 - DNA, 21 bp, Artificial Sequence
  Description of Artificial Sequence: Synthetic oligonucleotide
  Description of Combined DNA/RNA Molecule: Synthetic oligonucleotide
tgaaagccttggatggttttg

SEQ ID NO: 4672 - DNA, 21 bp, Artificial Sequence
  Description of Artificial Sequence: Synthetic oligonucleotide
  Description of Combined DNA/RNA Molecule: Synthetic oligonucleotide
gttttgttatggttctcacag

SEQ ID NO: 4673 - DNA, 21 bp, Artificial Sequence
  Description of Artificial Sequence: Synthetic oligonucleotide
  Description of Combined DNA/RNA Molecule: Synthetic oligonucleotide
ttatggttctcacagatgatg

SEQ ID NO: 4674 - DNA, 21 bp, Artificial Sequence
  Description of Artificial Sequence: Synthetic oligonucleotide
  Description of Combined DNA/RNA Molecule: Synthetic oligonucleotide
tatggttctcacagatgatgg

SEQ ID NO: 4675 - DNA, 21 bp, Artificial Sequence
  Description of Artificial Sequence: Synthetic oligonucleotide
  Description of Combined DNA/RNA Molecule: Synthetic oligonucleotide
cacagatgatggtgacatgat

SEQ ID NO: 4676 - DNA, 21 bp, Artificial Sequence
  Description of Artificial Sequence: Synthetic oligonucleotide
  Description of Combined DNA/RNA Molecule: Synthetic oligonucleotide
atgatggtgacatgatttaca

SEQ ID NO: 4677 - DNA, 21 bp, Artificial Sequence
  Description of Artificial Sequence: Synthetic oligonucleotide
  Description of Combined DNA/RNA Molecule: Synthetic oligonucleotide
tgatggtgacatgatttacat

SEQ ID NO: 4678 - DNA, 21 bp, Artificial Sequence
  Description of Artificial Sequence: Synthetic oligonucleotide
  Description of Combined DNA/RNA Molecule: Synthetic oligonucleotide
acatgatttacatttctgata

SEQ ID NO: 4679 - DNA, 21 bp, Artificial Sequence
  Description of Artificial Sequence: Synthetic oligonucleotide
  Description of Combined DNA/RNA Molecule: Synthetic oligonucleotide
atgatttacatttctgataat

SEQ ID NO: 4680 - DNA, 21 bp, Artificial Sequence
  Description of Artificial Sequence: Synthetic oligonucleotide
  Description of Combined DNA/RNA Molecule: Synthetic oligonucleotide
gatttacatttctgataatgt

SEQ ID NO: 4681 - DNA, 21 bp, Artificial Sequence
  Description of Artificial Sequence: Synthetic oligonucleotide
  Description of Combined DNA/RNA Molecule: Synthetic oligonucleotide
acatttctgataatgtgaaca

SEQ ID NO: 4682 - DNA, 21 bp, Artificial Sequence
  Description of Artificial Sequence: Synthetic oligonucleotide
  Description of Combined DNA/RNA Molecule: Synthetic oligonucleotide
gataatgtgaacaaatacatg

SEQ ID NO: 4683 - DNA, 21 bp, Artificial Sequence
  Description of Artificial Sequence: Synthetic oligonucleotide
  Description of Combined DNA/RNA Molecule: Synthetic oligonucleotide
ataatgtgaacaaatacatgg

SEQ ID NO: 4684 - DNA, 21 bp, Artificial Sequence
  Description of Artificial Sequence: Synthetic oligonucleotide
  Description of Combined DNA/RNA Molecule: Synthetic oligonucleotide
taatgtgaacaaatacatggg

SEQ ID NO: 4685 - DNA, 21 bp, Artificial Sequence
  Description of Artificial Sequence: Synthetic oligonucleotide
  Description of Combined DNA/RNA Molecule: Synthetic oligonucleotide
aatgtgaacaaatacatggga

SEQ ID NO: 4686 - DNA, 21 bp, Artificial Sequence
  Description of Artificial Sequence: Synthetic oligonucleotide
  Description of Combined DNA/RNA Molecule: Synthetic oligonucleotide
atgtgaacaaatacatgggat

SEQ ID NO: 4687 - DNA, 21 bp, Artificial Sequence
  Description of Artificial Sequence: Synthetic oligonucleotide
  Description of Combined DNA/RNA Molecule: Synthetic oligonucleotide
tgtgaacaaatacatgggatt

SEQ ID NO: 4688 - DNA, 21 bp, Artificial Sequence
  Description of Artificial Sequence: Synthetic oligonucleotide
  Description of Combined DNA/RNA Molecule: Synthetic oligonucleotide
tacatgggattaactcagttt

SEQ ID NO: 4689 - DNA, 21 bp, Artificial Sequence
  Description of Artificial Sequence: Synthetic oligonucleotide
  Description of Combined DNA/RNA Molecule: Synthetic oligonucleotide
acatgggattaactcagtttg

SEQ ID NO: 4690 - DNA, 21 bp, Artificial Sequence
  Description of Artificial Sequence: Synthetic oligonucleotide
  Description of Combined DNA/RNA Molecule: Synthetic oligonucleotide
agtttgaactaactggacaca

SEQ ID NO: 4691 - DNA, 21 bp, Artificial Sequence
  Description of Artificial Sequence: Synthetic oligonucleotide
  Description of Combined DNA/RNA Molecule: Synthetic oligonucleotide
aactggacacagtgtgtttga

SEQ ID NO: 4692 - DNA, 21 bp, Artificial Sequence
  Description of Artificial Sequence: Synthetic oligonucleotide
  Description of Combined DNA/RNA Molecule: Synthetic oligonucleotide
actggacacagtgtgtttgat

SEQ ID NO: 4693 - DNA, 21 bp, Artificial Sequence
  Description of Artificial Sequence: Synthetic oligonucleotide
  Description of Combined DNA/RNA Molecule: Synthetic oligonucleotide
tgtttgattttactcatccat

SEQ ID NO: 4694 - DNA, 21 bp, Artificial Sequence
  Description of Artificial Sequence: Synthetic oligonucleotide
  Description of Combined DNA/RNA Molecule: Synthetic oligonucleotide
tttgattttactcatccatgt

SEQ ID NO: 4695 - DNA, 21 bp, Artificial Sequence
  Description of Artificial Sequence: Synthetic oligonucleotide
  Description of Combined DNA/RNA Molecule: Synthetic oligonucleotide
tccatgtgaccatgaggaaat

SEQ ID NO: 4696 - DNA, 21 bp, Artificial Sequence
  Description of Artificial Sequence: Synthetic oligonucleotide
  Description of Combined DNA/RNA Molecule: Synthetic oligonucleotide
catgtgaccatgaggaaatga

SEQ ID NO: 4697 - DNA, 21 bp, Artificial Sequence
  Description of Artificial Sequence: Synthetic oligonucleotide
  Description of Combined DNA/RNA Molecule: Synthetic oligonucleotide
accatgaggaaatgagagaaa

SEQ ID NO: 4698 - DNA, 21 bp, Artificial Sequence
  Description of Artificial Sequence: Synthetic oligonucleotide
  Description of Combined DNA/RNA Molecule: Synthetic oligonucleotide
tgagagaaatgcttacacaca

SEQ ID NO: 4699 - DNA, 21 bp, Artificial Sequence
  Description of Artificial Sequence: Synthetic oligonucleotide
  Description of Combined DNA/RNA Molecule: Synthetic oligonucleotide
agaaatgcttacacacagaaa

SEQ ID NO: 4700 - DNA, 21 bp, Artificial Sequence
  Description of Artificial Sequence: Synthetic oligonucleotide
  Description of Combined DNA/RNA Molecule: Synthetic oligonucleotide
gaaatgcttacacacagaaat

SEQ ID NO: 4701 - DNA, 21 bp, Artificial Sequence
  Description of Artificial Sequence: Synthetic oligonucleotide
  Description of Combined DNA/RNA Molecule: Synthetic oligonucleotide
cagaaatggccttgtgaaaaa

SEQ ID NO: 4702 - DNA, 21 bp, Artificial Sequence
  Description of Artificial Sequence: Synthetic oligonucleotide
  Description of Combined DNA/RNA Molecule: Synthetic oligonucleotide
agaaatggccttgtgaaaaag

SEQ ID NO: 4703 - DNA, 21 bp, Artificial Sequence
  Description of Artificial Sequence: Synthetic oligonucleotide
  Description of Combined DNA/RNA Molecule: Synthetic oligonucleotide
gaaatggccttgtgaaaaagg

SEQ ID NO: 4704 - DNA, 21 bp, Artificial Sequence
  Description of Artificial Sequence: Synthetic oligonucleotide
  Description of Combined DNA/RNA Molecule: Synthetic oligonucleotide
aaatggccttgtgaaaaaggg

SEQ ID NO: 4705 - DNA, 21 bp, Artificial Sequence
  Description of Artificial Sequence: Synthetic oligonucleotide
  Description of Combined DNA/RNA Molecule: Synthetic oligonucleotide
gccttgtgaaaaagggtaaag

SEQ ID NO: 4706 - DNA, 21 bp, Artificial Sequence
  Description of Artificial Sequence: Synthetic oligonucleotide
  Description of Combined DNA/RNA Molecule: Synthetic oligonucleotide
taaagaacaaaacacacagcg

SEQ ID NO: 4707 - DNA, 21 bp, Artificial Sequence
  Description of Artificial Sequence: Synthetic oligonucleotide
  Description of Combined DNA/RNA Molecule: Synthetic oligonucleotide
agcttttttctcagaatgaag

SEQ ID NO: 4708 - DNA, 21 bp, Artificial Sequence
  Description of Artificial Sequence: Synthetic oligonucleotide
  Description of Combined DNA/RNA Molecule: Synthetic oligonucleotide
cttttttctcagaatgaagtg

SEQ ID NO: 4709 - DNA, 21 bp, Artificial Sequence
  Description of Artificial Sequence: Synthetic oligonucleotide
  Description of Combined DNA/RNA Molecule: Synthetic oligonucleotide
agaatgaagtgtaccctaact

SEQ ID NO: 4710 - DNA, 21 bp, Artificial Sequence
  Description of Artificial Sequence: Synthetic oligonucleotide
  Description of Combined DNA/RNA Molecule: Synthetic oligonucleotide
cgaggaagaactatgaacata

SEQ ID NO: 4711 - DNA, 21 bp, Artificial Sequence
  Description of Artificial Sequence: Synthetic oligonucleotide
  Description of Combined DNA/RNA Molecule: Synthetic oligonucleotide
gaggaagaactatgaacataa

SEQ ID NO: 4712 - DNA, 21 bp, Artificial Sequence
  Description of Artificial Sequence: Synthetic oligonucleotide
  Description of Combined DNA/RNA Molecule: Synthetic oligonucleotide
aggaagaactatgaacataaa

SEQ ID NO: 4713 - DNA, 21 bp, Artificial Sequence
  Description of Artificial Sequence: Synthetic oligonucleotide
  Description of Combined DNA/RNA Molecule: Synthetic oligonucleotide
cacaggccacattcacgtata

SEQ ID NO: 4714 - DNA, 21 bp, Artificial Sequence
  Description of Artificial Sequence: Synthetic oligonucleotide
  Description of Combined DNA/RNA Molecule: Synthetic oligonucleotide
tgtgggtataagaaaccacct

SEQ ID NO: 4715 - DNA, 21 bp, Artificial Sequence
  Description of Artificial Sequence: Synthetic oligonucleotide
  Description of Combined DNA/RNA Molecule: Synthetic oligonucleotide
gtgggtataagaaaccaccta

SEQ ID NO: 4716 - DNA, 21 bp, Artificial Sequence
  Description of Artificial Sequence: Synthetic oligonucleotide
  Description of Combined DNA/RNA Molecule: Synthetic oligonucleotide
aaatattgaaattcctttaga

SEQ ID NO: 4717 - DNA, 21 bp, Artificial Sequence
  Description of Artificial Sequence: Synthetic oligonucleotide
  Description of Combined DNA/RNA Molecule: Synthetic oligonucleotide
tgaaattcctttagatagcaa

SEQ ID NO: 4718 - DNA, 21 bp, Artificial Sequence
  Description of Artificial Sequence: Synthetic oligonucleotide
  Description of Combined DNA/RNA Molecule: Synthetic oligonucleotide
tggatatgaaattttcttatt

SEQ ID NO: 4719 - DNA, 21 bp, Artificial Sequence
  Description of Artificial Sequence: Synthetic oligonucleotide
  Description of Combined DNA/RNA Molecule: Synthetic oligonucleotide
atatgaaattttcttattgtg

SEQ ID NO: 4720 - DNA, 21 bp, Artificial Sequence
  Description of Artificial Sequence: Synthetic oligonucleotide
  Description of Combined DNA/RNA Molecule: Synthetic oligonucleotide
tatgaaattttcttattgtga

SEQ ID NO: 4721 - DNA, 21 bp, Artificial Sequence
  Description of Artificial Sequence: Synthetic oligonucleotide
  Description of Combined DNA/RNA Molecule: Synthetic oligonucleotide
atgaaattttcttattgtgat

SEQ ID NO: 4722 - DNA, 21 bp, Artificial Sequence
  Description of Artificial Sequence: Synthetic oligonucleotide
  Description of Combined DNA/RNA Molecule: Synthetic oligonucleotide
gaaattttcttattgtgatga

SEQ ID NO: 4723 - DNA, 21 bp, Artificial Sequence
  Description of Artificial Sequence: Synthetic oligonucleotide
  Description of Combined DNA/RNA Molecule: Synthetic oligonucleotide
aaattttcttattgtgatgaa

SEQ ID NO: 4724 - DNA, 21 bp, Artificial Sequence
  Description of Artificial Sequence: Synthetic oligonucleotide
  Description of Combined DNA/RNA Molecule: Synthetic oligonucleotide
aattttcttattgtgatgaaa

SEQ ID NO: 4725 - DNA, 21 bp, Artificial Sequence
  Description of Artificial Sequence: Synthetic oligonucleotide
  Description of Combined DNA/RNA Molecule: Synthetic oligonucleotide
ttcttattgtgatgaaagaat

SEQ ID NO: 4726 - DNA, 21 bp, Artificial Sequence
  Description of Artificial Sequence: Synthetic oligonucleotide
  Description of Combined DNA/RNA Molecule: Synthetic oligonucleotide
attgtgatgaaagaattaccg

SEQ ID NO: 4727 - DNA, 21 bp, Artificial Sequence
  Description of Artificial Sequence: Synthetic oligonucleotide
  Description of Combined DNA/RNA Molecule: Synthetic oligonucleotide
tgtgatgaaagaattaccgaa

SEQ ID NO: 4728 - DNA, 21 bp, Artificial Sequence
  Description of Artificial Sequence: Synthetic oligonucleotide
  Description of Combined DNA/RNA Molecule: Synthetic oligonucleotide
tgaaagaattaccgaattgat

SEQ ID NO: 4729 - DNA, 21 bp, Artificial Sequence
  Description of Artificial Sequence: Synthetic oligonucleotide
  Description of Combined DNA/RNA Molecule: Synthetic oligonucleotide
gaaagaattaccgaattgatg

SEQ ID NO: 4730 - DNA, 21 bp, Artificial Sequence
  Description of Artificial Sequence: Synthetic oligonucleotide
  Description of Combined DNA/RNA Molecule: Synthetic oligonucleotide
aaagaattaccgaattgatgg

SEQ ID NO: 4731 - DNA, 21 bp, Artificial Sequence
  Description of Artificial Sequence: Synthetic oligonucleotide
  Description of Combined DNA/RNA Molecule: Synthetic oligonucleotide
aagaattaccgaattgatggg

SEQ ID NO: 4732 - DNA, 21 bp, Artificial Sequence
  Description of Artificial Sequence: Synthetic oligonucleotide
  Description of Combined DNA/RNA Molecule: Synthetic oligonucleotide
tgatgggatatgagccagaag

SEQ ID NO: 4733 - DNA, 21 bp, Artificial Sequence
  Description of Artificial Sequence: Synthetic oligonucleotide
  Description of Combined DNA/RNA Molecule: Synthetic oligonucleotide
atatgagccagaagaactttt

SEQ ID NO: 4734 - DNA, 21 bp, Artificial Sequence
  Description of Artificial Sequence: Synthetic oligonucleotide
  Description of Combined DNA/RNA Molecule: Synthetic oligonucleotide
tttaggccgctcaatttatga

SEQ ID NO: 4735 - DNA, 21 bp, Artificial Sequence
  Description of Artificial Sequence: Synthetic oligonucleotide
  Description of Combined DNA/RNA Molecule: Synthetic oligonucleotide
tttatgaatattatcatgctt

SEQ ID NO: 4736 - DNA, 21 bp, Artificial Sequence
  Description of Artificial Sequence: Synthetic oligonucleotide
  Description of Combined DNA/RNA Molecule: Synthetic oligonucleotide
tatgaatattatcatgctttg

SEQ ID NO: 4737 - DNA, 21 bp, Artificial Sequence
  Description of Artificial Sequence: Synthetic oligonucleotide
  Description of Combined DNA/RNA Molecule: Synthetic oligonucleotide
atctgaccaaaactcatcatg

SEQ ID NO: 4738 - DNA, 21 bp, Artificial Sequence
  Description of Artificial Sequence: Synthetic oligonucleotide
  Description of Combined DNA/RNA Molecule: Synthetic oligonucleotide
accaaaactcatcatgatatg

SEQ ID NO: 4739 - DNA, 21 bp, Artificial Sequence
  Description of Artificial Sequence: Synthetic oligonucleotide
  Description of Combined DNA/RNA Molecule: Synthetic oligonucleotide
ccaaaactcatcatgatatgt

SEQ ID NO: 4740 - DNA, 21 bp, Artificial Sequence
  Description of Artificial Sequence: Synthetic oligonucleotide
  Description of Combined DNA/RNA Molecule: Synthetic oligonucleotide
atcatgatatgtttactaaag

SEQ ID NO: 4741 - DNA, 21 bp, Artificial Sequence
  Description of Artificial Sequence: Synthetic oligonucleotide
  Description of Combined DNA/RNA Molecule: Synthetic oligonucleotide
tgatatgtttactaaaggaca

SEQ ID NO: 4742 - DNA, 21 bp, Artificial Sequence
  Description of Artificial Sequence: Synthetic oligonucleotide
  Description of Combined DNA/RNA Molecule: Synthetic oligonucleotide
gaggtggatatgtctgggttg

SEQ ID NO: 4743 - DNA, 21 bp, Artificial Sequence
  Description of Artificial Sequence: Synthetic oligonucleotide
  Description of Combined DNA/RNA Molecule: Synthetic oligonucleotide
tgggttgaaactcaagcaact

SEQ ID NO: 4744 - DNA, 21 bp, Artificial Sequence
  Description of Artificial Sequence: Synthetic oligonucleotide
  Description of Combined DNA/RNA Molecule: Synthetic oligonucleotide
aactgtcatatataacaccaa

SEQ ID NO: 4745 - DNA, 21 bp, Artificial Sequence
  Description of Artificial Sequence: Synthetic oligonucleotide
  Description of Combined DNA/RNA Molecule: Synthetic oligonucleotide
accaagaattctcaaccacag

SEQ ID NO: 4746 - DNA, 21 bp, Artificial Sequence
  Description of Artificial Sequence: Synthetic oligonucleotide
  Description of Combined DNA/RNA Molecule: Synthetic oligonucleotide
cacagtgcattgtatgtgtga

SEQ ID NO: 4747 - DNA, 21 bp, Artificial Sequence
  Description of Artificial Sequence: Synthetic oligonucleotide
  Description of Combined DNA/RNA Molecule: Synthetic oligonucleotide
acagtgcattgtatgtgtgaa

SEQ ID NO: 4748 - DNA, 21 bp, Artificial Sequence
  Description of Artificial Sequence: Synthetic oligonucleotide
  Description of Combined DNA/RNA Molecule: Synthetic oligonucleotide
atgtgtgaattacgttgtgag

SEQ ID NO: 4749 - DNA, 21 bp, Artificial Sequence
  Description of Artificial Sequence: Synthetic oligonucleotide
  Description of Combined DNA/RNA Molecule: Synthetic oligonucleotide
tgtgtgaattacgttgtgagt

SEQ ID NO: 4750 - DNA, 21 bp, Artificial Sequence
  Description of Artificial Sequence: Synthetic oligonucleotide
  Description of Combined DNA/RNA Molecule: Synthetic oligonucleotide
gtgtgaattacgttgtgagtg

SEQ ID NO: 4751 - DNA, 21 bp, Artificial Sequence
  Description of Artificial Sequence: Synthetic oligonucleotide
  Description of Combined DNA/RNA Molecule: Synthetic oligonucleotide
tgtgaattacgttgtgagtgg

SEQ ID NO: 4752 - DNA, 21 bp, Artificial Sequence
  Description of Artificial Sequence: Synthetic oligonucleotide
  Description of Combined DNA/RNA Molecule: Synthetic oligonucleotide
tggtattattcagcacgactt

SEQ ID NO: 4753 - DNA, 21 bp, Artificial Sequence
  Description of Artificial Sequence: Synthetic oligonucleotide
  Description of Combined DNA/RNA Molecule: Synthetic oligonucleotide
cttgattttctcccttcaaca

SEQ ID NO: 4754 - DNA, 21 bp, Artificial Sequence
  Description of Artificial Sequence: Synthetic oligonucleotide
  Description of Combined DNA/RNA Molecule: Synthetic oligonucleotide
aacaaacagaatgtgtcctta

SEQ ID NO: 4755 - DNA, 21 bp, Artificial Sequence
  Description of Artificial Sequence: Synthetic oligonucleotide
  Description of Combined DNA/RNA Molecule: Synthetic oligonucleotide
aatgtgtccttaaaccggttg

SEQ ID NO: 4756 - DNA, 21 bp, Artificial Sequence
  Description of Artificial Sequence: Synthetic oligonucleotide
  Description of Combined DNA/RNA Molecule: Synthetic oligonucleotide
accggttgaatcttcagatat

SEQ ID NO: 4757 - DNA, 21 bp, Artificial Sequence
  Description of Artificial Sequence: Synthetic oligonucleotide
  Description of Combined DNA/RNA Molecule: Synthetic oligonucleotide
ccggttgaatcttcagatatg

SEQ ID NO: 4758 - DNA, 21 bp, Artificial Sequence
  Description of Artificial Sequence: Synthetic oligonucleotide
  Description of Combined DNA/RNA Molecule: Synthetic oligonucleotide
cggttgaatcttcagatatga

SEQ ID NO: 4759 - DNA, 21 bp, Artificial Sequence
  Description of Artificial Sequence: Synthetic oligonucleotide
  Description of Combined DNA/RNA Molecule: Synthetic oligonucleotide
gttgaatcttcagatatgaaa

SEQ ID NO: 4760 - DNA, 21 bp, Artificial Sequence
  Description of Artificial Sequence: Synthetic oligonucleotide
  Description of Combined DNA/RNA Molecule: Synthetic oligonucleotide
ttgaatcttcagatatgaaaa

SEQ ID NO: 4761 - DNA, 21 bp, Artificial Sequence
  Description of Artificial Sequence: Synthetic oligonucleotide
  Description of Combined DNA/RNA Molecule: Synthetic oligonucleotide
agatatgaaaatgactcagct

SEQ ID NO: 4762 - DNA, 21 bp, Artificial Sequence
  Description of Artificial Sequence: Synthetic oligonucleotide
  Description of Combined DNA/RNA Molecule: Synthetic oligonucleotide
gatatgaaaatgactcagcta

SEQ ID NO: 4763 - DNA, 21 bp, Artificial Sequence
  Description of Artificial Sequence: Synthetic oligonucleotide
  Description of Combined DNA/RNA Molecule: Synthetic oligonucleotide
aaagttgaatcagaagataca

SEQ ID NO: 4764 - DNA, 21 bp, Artificial Sequence
  Description of Artificial Sequence: Synthetic oligonucleotide
  Description of Combined DNA/RNA Molecule: Synthetic oligonucleotide
agttgaatcagaagatacaag

SEQ ID NO: 4765 - DNA, 21 bp, Artificial Sequence
  Description of Artificial Sequence: Synthetic oligonucleotide
  Description of Combined DNA/RNA Molecule: Synthetic oligonucleotide
cagaagatacaagtagcctct

SEQ ID NO: 4766 - DNA, 21 bp, Artificial Sequence
  Description of Artificial Sequence: Synthetic oligonucleotide
  Description of Combined DNA/RNA Molecule: Synthetic oligonucleotide
agaagatacaagtagcctctt

SEQ ID NO: 4767 - DNA, 21 bp, Artificial Sequence
  Description of Artificial Sequence: Synthetic oligonucleotide
  Description of Combined DNA/RNA Molecule: Synthetic oligonucleotide
gaagatacaagtagcctcttt

SEQ ID NO: 4768 - DNA, 21 bp, Artificial Sequence
  Description of Artificial Sequence: Synthetic oligonucleotide
  Description of Combined DNA/RNA Molecule: Synthetic oligonucleotide
ctctttgacaaacttaagaag

SEQ ID NO: 4769 - DNA, 21 bp, Artificial Sequence
  Description of Artificial Sequence: Synthetic oligonucleotide
  Description of Combined DNA/RNA Molecule: Synthetic oligonucleotide
tctttgacaaacttaagaagg

SEQ ID NO: 4770 - DNA, 21 bp, Artificial Sequence
  Description of Artificial Sequence: Synthetic oligonucleotide
  Description of Combined DNA/RNA Molecule: Synthetic oligonucleotide
acctgatgctttaactttgct

SEQ ID NO: 4771 - DNA, 21 bp, Artificial Sequence
  Description of Artificial Sequence: Synthetic oligonucleotide
  Description of Combined DNA/RNA Molecule: Synthetic oligonucleotide
ctggagacacaatcatatctt

SEQ ID NO: 4772 - DNA, 21 bp, Artificial Sequence
  Description of Artificial Sequence: Synthetic oligonucleotide
  Description of Combined DNA/RNA Molecule: Synthetic oligonucleotide
tggagacacaatcatatcttt

SEQ ID NO: 4773 - DNA, 21 bp, Artificial Sequence
  Description of Artificial Sequence: Synthetic oligonucleotide
  Description of Combined DNA/RNA Molecule: Synthetic oligonucleotide
aacttgaggaagtaccattat

SEQ ID NO: 4774 - DNA, 21 bp, Artificial Sequence
  Description of Artificial Sequence: Synthetic oligonucleotide
  Description of Combined DNA/RNA Molecule: Synthetic oligonucleotide
acttgaggaagtaccattata

SEQ ID NO: 4775 - DNA, 21 bp, Artificial Sequence
  Description of Artificial Sequence: Synthetic oligonucleotide
  Description of Combined DNA/RNA Molecule: Synthetic oligonucleotide
ttgaggaagtaccattatata

SEQ ID NO: 4776 - DNA, 21 bp, Artificial Sequence
  Description of Artificial Sequence: Synthetic oligonucleotide
  Description of Combined DNA/RNA Molecule: Synthetic oligonucleotide
tgaggaagtaccattatataa

SEQ ID NO: 4777 - DNA, 21 bp, Artificial Sequence
  Description of Artificial Sequence: Synthetic oligonucleotide
  Description of Combined DNA/RNA Molecule: Synthetic oligonucleotide
aggaagtaccattatataatg

SEQ ID NO: 4778 - DNA, 21 bp, Artificial Sequence
  Description of Artificial Sequence: Synthetic oligonucleotide
  Description of Combined DNA/RNA Molecule: Synthetic oligonucleotide
ggaagtaccattatataatga

SEQ ID NO: 4779 - DNA, 21 bp, Artificial Sequence
  Description of Artificial Sequence: Synthetic oligonucleotide
  Description of Combined DNA/RNA Molecule: Synthetic oligonucleotide
aacgaaaaattacagaatata

SEQ ID NO: 4780 - DNA, 21 bp, Artificial Sequence
  Description of Artificial Sequence: Synthetic oligonucleotide
  Description of Combined DNA/RNA Molecule: Synthetic oligonucleotide
acgaaaaattacagaatataa

SEQ ID NO: 4781 - DNA, 21 bp, Artificial Sequence
  Description of Artificial Sequence: Synthetic oligonucleotide
  Description of Combined DNA/RNA Molecule: Synthetic oligonucleotide
aaaaattacagaatataaatt

SEQ ID NO: 4782 - DNA, 21 bp, Artificial Sequence
  Description of Artificial Sequence: Synthetic oligonucleotide
  Description of Combined DNA/RNA Molecule: Synthetic oligonucleotide
tacagaatataaatttggcaa

SEQ ID NO: 4783 - DNA, 21 bp, Artificial Sequence
  Description of Artificial Sequence: Synthetic oligonucleotide
  Description of Combined DNA/RNA Molecule: Synthetic oligonucleotide
acagaatataaatttggcaat

SEQ ID NO: 4784 - DNA, 21 bp, Artificial Sequence
  Description of Artificial Sequence: Synthetic oligonucleotide
  Description of Combined DNA/RNA Molecule: Synthetic oligonucleotide
atcaagaagttgcattaaaat

SEQ ID NO: 4785 - DNA, 21 bp, Artificial Sequence
  Description of Artificial Sequence: Synthetic oligonucleotide
  Description of Combined DNA/RNA Molecule: Synthetic oligonucleotide
tcaagaagttgcattaaaatt

SEQ ID NO: 4786 - DNA, 21 bp, Artificial Sequence
  Description of Artificial Sequence: Synthetic oligonucleotide
  Description of Combined DNA/RNA Molecule: Synthetic oligonucleotide
taaaattagaaccaaatccag

SEQ ID NO: 4787 - DNA, 21 bp, Artificial Sequence
  Description of Artificial Sequence: Synthetic oligonucleotide
  Description of Combined DNA/RNA Molecule: Synthetic oligonucleotide
aaaattagaaccaaatccaga

SEQ ID NO: 4788 - DNA, 21 bp, Artificial Sequence
  Description of Artificial Sequence: Synthetic oligonucleotide
  Description of Combined DNA/RNA Molecule: Synthetic oligonucleotide
ccagagtcactggaactttct

SEQ ID NO: 4789 - DNA, 21 bp, Artificial Sequence
  Description of Artificial Sequence: Synthetic oligonucleotide
  Description of Combined DNA/RNA Molecule: Synthetic oligonucleotide
cagagtcactggaactttctt

SEQ ID NO: 4790 - DNA, 21 bp, Artificial Sequence
  Description of Artificial Sequence: Synthetic oligonucleotide
  Description of Combined DNA/RNA Molecule: Synthetic oligonucleotide
cactggaactttcttttacca

SEQ ID NO: 4791 - DNA, 21 bp, Artificial Sequence
  Description of Artificial Sequence: Synthetic oligonucleotide
  Description of Combined DNA/RNA Molecule: Synthetic oligonucleotide
gcctaatagtcccagtgaata

SEQ ID NO: 4792 - DNA, 21 bp, Artificial Sequence
  Description of Artificial Sequence: Synthetic oligonucleotide
  Description of Combined DNA/RNA Molecule: Synthetic oligonucleotide
cctaatagtcccagtgaatat

SEQ ID NO: 4793 - DNA, 21 bp, Artificial Sequence
  Description of Artificial Sequence: Synthetic oligonucleotide
  Description of Combined DNA/RNA Molecule: Synthetic oligonucleotide
ctaatagtcccagtgaatatt

SEQ ID NO: 4794 - DNA, 21 bp, Artificial Sequence
  Description of Artificial Sequence: Synthetic oligonucleotide
  Description of Combined DNA/RNA Molecule: Synthetic oligonucleotide
taatagtcccagtgaatattg

SEQ ID NO: 4795 - DNA, 21 bp, Artificial Sequence
  Description of Artificial Sequence: Synthetic oligonucleotide
  Description of Combined DNA/RNA Molecule: Synthetic oligonucleotide
aatagtcccagtgaatattgt

SEQ ID NO: 4796 - DNA, 21 bp, Artificial Sequence
  Description of Artificial Sequence: Synthetic oligonucleotide
  Description of Combined DNA/RNA Molecule: Synthetic oligonucleotide
cagtgaatattgtttttatgt

SEQ ID NO: 4797 - DNA, 21 bp, Artificial Sequence
  Description of Artificial Sequence: Synthetic oligonucleotide
  Description of Combined DNA/RNA Molecule: Synthetic oligonucleotide
agtgaatattgtttttatgtg

SEQ ID NO: 4798 - DNA, 21 bp, Artificial Sequence
  Description of Artificial Sequence: Synthetic oligonucleotide
  Description of Combined DNA/RNA Molecule: Synthetic oligonucleotide
tgaatattgtttttatgtgga

SEQ ID NO: 4799 - DNA, 21 bp, Artificial Sequence
  Description of Artificial Sequence: Synthetic oligonucleotide
  Description of Combined DNA/RNA Molecule: Synthetic oligonucleotide
aatattgtttttatgtggata

SEQ ID NO: 4800 - DNA, 21 bp, Artificial Sequence
  Description of Artificial Sequence: Synthetic oligonucleotide
  Description of Combined DNA/RNA Molecule: Synthetic oligonucleotide
atattgtttttatgtggatag

SEQ ID NO: 4801 - DNA, 21 bp, Artificial Sequence
  Description of Artificial Sequence: Synthetic oligonucleotide
  Description of Combined DNA/RNA Molecule: Synthetic oligonucleotide
attgtttttatgtggatagtg

SEQ ID NO: 4802 - DNA, 21 bp, Artificial Sequence
  Description of Artificial Sequence: Synthetic oligonucleotide
  Description of Combined DNA/RNA Molecule: Synthetic oligonucleotide
gtttttatgtggatagtgata

SEQ ID NO: 4803 - DNA, 21 bp, Artificial Sequence
  Description of Artificial Sequence: Synthetic oligonucleotide
  Description of Combined DNA/RNA Molecule: Synthetic oligonucleotide
tgtggatagtgatatggtcaa

SEQ ID NO: 4804 - DNA, 21 bp, Artificial Sequence
  Description of Artificial Sequence: Synthetic oligonucleotide
  Description of Combined DNA/RNA Molecule: Synthetic oligonucleotide
tggatagtgatatggtcaatg

SEQ ID NO: 4805 - DNA, 21 bp, Artificial Sequence
  Description of Artificial Sequence: Synthetic oligonucleotide
  Description of Combined DNA/RNA Molecule: Synthetic oligonucleotide
ggatagtgatatggtcaatga

SEQ ID NO: 4806 - DNA, 21 bp, Artificial Sequence
  Description of Artificial Sequence: Synthetic oligonucleotide
  Description of Combined DNA/RNA Molecule: Synthetic oligonucleotide
gatagtgatatggtcaatgaa

SEQ ID NO: 4807 - DNA, 21 bp, Artificial Sequence
  Description of Artificial Sequence: Synthetic oligonucleotide
  Description of Combined DNA/RNA Molecule: Synthetic oligonucleotide
gtgatatggtcaatgaattca

SEQ ID NO: 4808 - DNA, 21 bp, Artificial Sequence
  Description of Artificial Sequence: Synthetic oligonucleotide
  Description of Combined DNA/RNA Molecule: Synthetic oligonucleotide
atatggtcaatgaattcaagt

SEQ ID NO: 4809 - DNA, 21 bp, Artificial Sequence
  Description of Artificial Sequence: Synthetic oligonucleotide
  Description of Combined DNA/RNA Molecule: Synthetic oligonucleotide
tatggtcaatgaattcaagtt

SEQ ID NO: 4810 - DNA, 21 bp, Artificial Sequence
  Description of Artificial Sequence: Synthetic oligonucleotide
  Description of Combined DNA/RNA Molecule: Synthetic oligonucleotide
tcaatgaattcaagttggaat

SEQ ID NO: 4811 - DNA, 21 bp, Artificial Sequence
  Description of Artificial Sequence: Synthetic oligonucleotide
  Description of Combined DNA/RNA Molecule: Synthetic oligonucleotide
caatgaattcaagttggaatt

SEQ ID NO: 4812 - DNA, 21 bp, Artificial Sequence
  Description of Artificial Sequence: Synthetic oligonucleotide
  Description of Combined DNA/RNA Molecule: Synthetic oligonucleotide
atgaattcaagttggaattgg

SEQ ID NO: 4813 - DNA, 21 bp, Artificial Sequence
  Description of Artificial Sequence: Synthetic oligonucleotide
  Description of Combined DNA/RNA Molecule: Synthetic oligonucleotide
tcaagttggaattggtagaaa

SEQ ID NO: 4814 - DNA, 21 bp, Artificial Sequence
  Description of Artificial Sequence: Synthetic oligonucleotide
  Description of Combined DNA/RNA Molecule: Synthetic oligonucleotide
tggaattggtagaaaaacttt

SEQ ID NO: 4815 - DNA, 21 bp, Artificial Sequence
  Description of Artificial Sequence: Synthetic oligonucleotide
  Description of Combined DNA/RNA Molecule: Synthetic oligonucleotide
ggaattggtagaaaaactttt

SEQ ID NO: 4816 - DNA, 21 bp, Artificial Sequence
  Description of Artificial Sequence: Synthetic oligonucleotide
  Description of Combined DNA/RNA Molecule: Synthetic oligonucleotide
ggtagaaaaactttttgctga

SEQ ID NO: 4817 - DNA, 21 bp, Artificial Sequence
  Description of Artificial Sequence: Synthetic oligonucleotide
  Description of Combined DNA/RNA Molecule: Synthetic oligonucleotide
gtagaaaaactttttgctgaa

SEQ ID NO: 4818 - DNA, 21 bp, Artificial Sequence
  Description of Artificial Sequence: Synthetic oligonucleotide
  Description of Combined DNA/RNA Molecule: Synthetic oligonucleotide
aactttttgctgaagacacag

SEQ ID NO: 4819 - DNA, 21 bp, Artificial Sequence
  Description of Artificial Sequence: Synthetic oligonucleotide
  Description of Combined DNA/RNA Molecule: Synthetic oligonucleotide
tgctgaagacacagaagcaaa

SEQ ID NO: 4820 - DNA, 21 bp, Artificial Sequence
  Description of Artificial Sequence: Synthetic oligonucleotide
  Description of Combined DNA/RNA Molecule: Synthetic oligonucleotide
gctgaagacacagaagcaaag

SEQ ID NO: 4821 - DNA, 21 bp, Artificial Sequence
  Description of Artificial Sequence: Synthetic oligonucleotide
  Description of Combined DNA/RNA Molecule: Synthetic oligonucleotide
cacagaagcaaagaacccatt

SEQ ID NO: 4822 - DNA, 21 bp, Artificial Sequence
  Description of Artificial Sequence: Synthetic oligonucleotide
  Description of Combined DNA/RNA Molecule: Synthetic oligonucleotide
aaagaacccattttctactca

SEQ ID NO: 4823 - DNA, 21 bp, Artificial Sequence
  Description of Artificial Sequence: Synthetic oligonucleotide
  Description of Combined DNA/RNA Molecule: Synthetic oligonucleotide
ctcaggacacagatttagact

SEQ ID NO: 4824 - DNA, 21 bp, Artificial Sequence
  Description of Artificial Sequence: Synthetic oligonucleotide
  Description of Combined DNA/RNA Molecule: Synthetic oligonucleotide
cacagatttagacttggagat

SEQ ID NO: 4825 - DNA, 21 bp, Artificial Sequence
  Description of Artificial Sequence: Synthetic oligonucleotide
  Description of Combined DNA/RNA Molecule: Synthetic oligonucleotide
cagatttagacttggagatgt

SEQ ID NO: 4826 - DNA, 21 bp, Artificial Sequence
  Description of Artificial Sequence: Synthetic oligonucleotide
  Description of Combined DNA/RNA Molecule: Synthetic oligonucleotide
agatttagacttggagatgtt

SEQ ID NO: 4827 - DNA, 21 bp, Artificial Sequence
  Description of Artificial Sequence: Synthetic oligonucleotide
  Description of Combined DNA/RNA Molecule: Synthetic oligonucleotide
ttggagatgttagctccctat

SEQ ID NO: 4828 - DNA, 21 bp, Artificial Sequence
  Description of Artificial Sequence: Synthetic oligonucleotide
  Description of Combined DNA/RNA Molecule: Synthetic oligonucleotide
ggatgatgacttccagttacg

SEQ ID NO: 4829 - DNA, 21 bp, Artificial Sequence
  Description of Artificial Sequence: Synthetic oligonucleotide
  Description of Combined DNA/RNA Molecule: Synthetic oligonucleotide
ttcgatcagttgtcaccatta

SEQ ID NO: 4830 - DNA, 21 bp, Artificial Sequence
  Description of Artificial Sequence: Synthetic oligonucleotide
  Description of Combined DNA/RNA Molecule: Synthetic oligonucleotide
agttgtcaccattagaaagca

SEQ ID NO: 4831 - DNA, 21 bp, Artificial Sequence
  Description of Artificial Sequence: Synthetic oligonucleotide
  Description of Combined DNA/RNA Molecule: Synthetic oligonucleotide
cacagttacagtattccagca

SEQ ID NO: 4832 - DNA, 21 bp, Artificial Sequence
  Description of Artificial Sequence: Synthetic oligonucleotide
  Description of Combined DNA/RNA Molecule: Synthetic oligonucleotide
atgaattaaaaacagtgacaa

SEQ ID NO: 4833 - DNA, 21 bp, Artificial Sequence
  Description of Artificial Sequence: Synthetic oligonucleotide
  Description of Combined DNA/RNA Molecule: Synthetic oligonucleotide
tgaattaaaaacagtgacaaa

SEQ ID NO: 4834 - DNA, 21 bp, Artificial Sequence
  Description of Artificial Sequence: Synthetic oligonucleotide
  Description of Combined DNA/RNA Molecule: Synthetic oligonucleotide
gaattaaaaacagtgacaaaa

SEQ ID NO: 4835 - DNA, 21 bp, Artificial Sequence
  Description of Artificial Sequence: Synthetic oligonucleotide
  Description of Combined DNA/RNA Molecule: Synthetic oligonucleotide
aacagtgacaaaagaccgtat

SEQ ID NO: 4836 - DNA, 21 bp, Artificial Sequence
  Description of Artificial Sequence: Synthetic oligonucleotide
  Description of Combined DNA/RNA Molecule: Synthetic oligonucleotide
cagtgacaaaagaccgtatgg

SEQ ID NO: 4837 - DNA, 21 bp, Artificial Sequence
  Description of Artificial Sequence: Synthetic oligonucleotide
  Description of Combined DNA/RNA Molecule: Synthetic oligonucleotide
accgtatggaagacattaaaa

SEQ ID NO: 4838 - DNA, 21 bp, Artificial Sequence
  Description of Artificial Sequence: Synthetic oligonucleotide
  Description of Combined DNA/RNA Molecule: Synthetic oligonucleotide
gtatggaagacattaaaatat

SEQ ID NO: 4839 - DNA, 21 bp, Artificial Sequence
  Description of Artificial Sequence: Synthetic oligonucleotide
  Description of Combined DNA/RNA Molecule: Synthetic oligonucleotide
tatggaagacattaaaatatt

SEQ ID NO: 4840 - DNA, 21 bp, Artificial Sequence
  Description of Artificial Sequence: Synthetic oligonucleotide
  Description of Combined DNA/RNA Molecule: Synthetic oligonucleotide
tggaagacattaaaatattga

SEQ ID NO: 4841 - DNA, 21 bp, Artificial Sequence
  Description of Artificial Sequence: Synthetic oligonucleotide
  Description of Combined DNA/RNA Molecule: Synthetic oligonucleotide
atatagagatactcaaagtcg

SEQ ID NO: 4842 - DNA, 21 bp, Artificial Sequence
  Description of Artificial Sequence: Synthetic oligonucleotide
  Description of Combined DNA/RNA Molecule: Synthetic oligonucleotide
aggaaaaggagtcatagaaca

SEQ ID NO: 4843 - DNA, 21 bp, Artificial Sequence
  Description of Artificial Sequence: Synthetic oligonucleotide
  Description of Combined DNA/RNA Molecule: Synthetic oligonucleotide
aaaggagtcatagaacagaca

SEQ ID NO: 4844 - DNA, 21 bp, Artificial Sequence
  Description of Artificial Sequence: Synthetic oligonucleotide
  Description of Combined DNA/RNA Molecule: Synthetic oligonucleotide
aaggagtcatagaacagacag

SEQ ID NO: 4845 - DNA, 21 bp, Artificial Sequence
  Description of Artificial Sequence: Synthetic oligonucleotide
  Description of Combined DNA/RNA Molecule: Synthetic oligonucleotide
gacagaaaaatctcatccaag

SEQ ID NO: 4846 - DNA, 21 bp, Artificial Sequence
  Description of Artificial Sequence: Synthetic oligonucleotide
  Description of Combined DNA/RNA Molecule: Synthetic oligonucleotide
acagaaaaatctcatccaaga

SEQ ID NO: 4847 - DNA, 21 bp, Artificial Sequence
  Description of Artificial Sequence: Synthetic oligonucleotide
  Description of Combined DNA/RNA Molecule: Synthetic oligonucleotide
aacgtgttatctgtcgctttg

SEQ ID NO: 4848 - DNA, 21 bp, Artificial Sequence
  Description of Artificial Sequence: Synthetic oligonucleotide
  Description of Combined DNA/RNA Molecule: Synthetic oligonucleotide
acgtgttatctgtcgctttga

SEQ ID NO: 4849 - DNA, 21 bp, Artificial Sequence
  Description of Artificial Sequence: Synthetic oligonucleotide
  Description of Combined DNA/RNA Molecule: Synthetic oligonucleotide
atctgtcgctttgagtcaaag

SEQ ID NO: 4850 - DNA, 21 bp, Artificial Sequence
  Description of Artificial Sequence: Synthetic oligonucleotide
  Description of Combined DNA/RNA Molecule: Synthetic oligonucleotide
gctttgagtcaaagaactaca

SEQ ID NO: 4851 - DNA, 21 bp, Artificial Sequence
  Description of Artificial Sequence: Synthetic oligonucleotide
  Description of Combined DNA/RNA Molecule: Synthetic oligonucleotide
ctttgagtcaaagaactacag

SEQ ID NO: 4852 - DNA, 21 bp, Artificial Sequence
  Description of Artificial Sequence: Synthetic oligonucleotide
  Description of Combined DNA/RNA Molecule: Synthetic oligonucleotide
gtcaaagaactacagttcctg

SEQ ID NO: 4853 - DNA, 21 bp, Artificial Sequence
  Description of Artificial Sequence: Synthetic oligonucleotide
  Description of Combined DNA/RNA Molecule: Synthetic oligonucleotide
tcaaagaactacagttcctga

SEQ ID NO: 4854 - DNA, 21 bp, Artificial Sequence
  Description of Artificial Sequence: Synthetic oligonucleotide
  Description of Combined DNA/RNA Molecule: Synthetic oligonucleotide
ctgaggaagaactaaatccaa

SEQ ID NO: 4855 - DNA, 21 bp, Artificial Sequence
  Description of Artificial Sequence: Synthetic oligonucleotide
  Description of Combined DNA/RNA Molecule: Synthetic oligonucleotide
tgaggaagaactaaatccaaa

SEQ ID NO: 4856 - DNA, 21 bp, Artificial Sequence
  Description of Artificial Sequence: Synthetic oligonucleotide
  Description of Combined DNA/RNA Molecule: Synthetic oligonucleotide
gaggaagaactaaatccaaag

SEQ ID NO: 4857 - DNA, 21 bp, Artificial Sequence
  Description of Artificial Sequence: Synthetic oligonucleotide
  Description of Combined DNA/RNA Molecule: Synthetic oligonucleotide
aggaagaactaaatccaaaga

SEQ ID NO: 4858 - DNA, 21 bp, Artificial Sequence
  Description of Artificial Sequence: Synthetic oligonucleotide
  Description of Combined DNA/RNA Molecule: Synthetic oligonucleotide
ctaaatccaaagatactagct

SEQ ID NO: 4859 - DNA, 21 bp, Artificial Sequence
  Description of Artificial Sequence: Synthetic oligonucleotide
  Description of Combined DNA/RNA Molecule: Synthetic oligonucleotide
tccaaagatactagctttgca

SEQ ID NO: 4860 - DNA, 21 bp, Artificial Sequence
  Description of Artificial Sequence: Synthetic oligonucleotide
  Description of Combined DNA/RNA Molecule: Synthetic oligonucleotide
caaagatactagctttgcaga

SEQ ID NO: 4861 - DNA, 21 bp, Artificial Sequence
  Description of Artificial Sequence: Synthetic oligonucleotide
  Description of Combined DNA/RNA Molecule: Synthetic oligonucleotide
aaagatactagctttgcagaa

SEQ ID NO: 4862 - DNA, 21 bp, Artificial Sequence
  Description of Artificial Sequence: Synthetic oligonucleotide
  Description of Combined DNA/RNA Molecule: Synthetic oligonucleotide
gagaaagcgaaaaatggaaca

SEQ ID NO: 4863 - DNA, 21 bp, Artificial Sequence
  Description of Artificial Sequence: Synthetic oligonucleotide
  Description of Combined DNA/RNA Molecule: Synthetic oligonucleotide
aatggaacatgatggttcact

SEQ ID NO: 4864 - DNA, 21 bp, Artificial Sequence
  Description of Artificial Sequence: Synthetic oligonucleotide
  Description of Combined DNA/RNA Molecule: Synthetic oligonucleotide
acatgatggttcactttttca

SEQ ID NO: 4865 - DNA, 21 bp, Artificial Sequence
  Description of Artificial Sequence: Synthetic oligonucleotide
  Description of Combined DNA/RNA Molecule: Synthetic oligonucleotide
actttttcaagcagtaggaat

SEQ ID NO: 4866 - DNA, 21 bp, Artificial Sequence
  Description of Artificial Sequence: Synthetic oligonucleotide
  Description of Combined DNA/RNA Molecule: Synthetic oligonucleotide
agcagtaggaattggaacatt

SEQ ID NO: 4867 - DNA, 21 bp, Artificial Sequence
  Description of Artificial Sequence: Synthetic oligonucleotide
  Description of Combined DNA/RNA Molecule: Synthetic oligonucleotide
gcagtaggaattggaacatta

SEQ ID NO: 4868 - DNA, 21 bp, Artificial Sequence
  Description of Artificial Sequence: Synthetic oligonucleotide
  Description of Combined DNA/RNA Molecule: Synthetic oligonucleotide
cagtaggaattggaacattat

SEQ ID NO: 4869 - DNA, 21 bp, Artificial Sequence
  Description of Artificial Sequence: Synthetic oligonucleotide
  Description of Combined DNA/RNA Molecule: Synthetic oligonucleotide
ttcttggaaacgtgtaaaagg

SEQ ID NO: 4870 - DNA, 21 bp, Artificial Sequence
  Description of Artificial Sequence: Synthetic oligonucleotide
  Description of Combined DNA/RNA Molecule: Synthetic oligonucleotide
tcttggaaacgtgtaaaagga

SEQ ID NO: 4871 - DNA, 21 bp, Artificial Sequence
  Description of Artificial Sequence: Synthetic oligonucleotide
  Description of Combined DNA/RNA Molecule: Synthetic oligonucleotide
tgtaaaaggatgcaaatctag

SEQ ID NO: 4872 - DNA, 21 bp, Artificial Sequence
  Description of Artificial Sequence: Synthetic oligonucleotide
  Description of Combined DNA/RNA Molecule: Synthetic oligonucleotide
gtaaaaggatgcaaatctagt

SEQ ID NO: 4873 - DNA, 21 bp, Artificial Sequence
  Description of Artificial Sequence: Synthetic oligonucleotide
  Description of Combined DNA/RNA Molecule: Synthetic oligonucleotide
aggatgcaaatctagtgaaca

SEQ ID NO: 4874 - DNA, 21 bp, Artificial Sequence
  Description of Artificial Sequence: Synthetic oligonucleotide
  Description of Combined DNA/RNA Molecule: Synthetic oligonucleotide
tgcaaatctagtgaacagaat

SEQ ID NO: 4875 - DNA, 21 bp, Artificial Sequence
  Description of Artificial Sequence: Synthetic oligonucleotide
  Description of Combined DNA/RNA Molecule: Synthetic oligonucleotide
tctagtgaacagaatggaatg

SEQ ID NO: 4876 - DNA, 21 bp, Artificial Sequence
  Description of Artificial Sequence: Synthetic oligonucleotide
  Description of Combined DNA/RNA Molecule: Synthetic oligonucleotide
ctagtgaacagaatggaatgg

SEQ ID NO: 4877 - DNA, 21 bp, Artificial Sequence
  Description of Artificial Sequence: Synthetic oligonucleotide
  Description of Combined DNA/RNA Molecule: Synthetic oligonucleotide
acagaatggaatggagcaaaa

SEQ ID NO: 4878 - DNA, 21 bp, Artificial Sequence
  Description of Artificial Sequence: Synthetic oligonucleotide
  Description of Combined DNA/RNA Molecule: Synthetic oligonucleotide
atggaatggagcaaaagacaa

SEQ ID NO: 4879 - DNA, 21 bp, Artificial Sequence
  Description of Artificial Sequence: Synthetic oligonucleotide
  Description of Combined DNA/RNA Molecule: Synthetic oligonucleotide
ggaatggagcaaaagacaatt

SEQ ID NO: 4880 - DNA, 21 bp, Artificial Sequence
  Description of Artificial Sequence: Synthetic oligonucleotide
  Description of Combined DNA/RNA Molecule: Synthetic oligonucleotide
gaatggagcaaaagacaatta

SEQ ID NO: 4881 - DNA, 21 bp, Artificial Sequence
  Description of Artificial Sequence: Synthetic oligonucleotide
  Description of Combined DNA/RNA Molecule: Synthetic oligonucleotide
aatggagcaaaagacaattat

SEQ ID NO: 4882 - DNA, 21 bp, Artificial Sequence
  Description of Artificial Sequence: Synthetic oligonucleotide
  Description of Combined DNA/RNA Molecule: Synthetic oligonucleotide
atggagcaaaagacaattatt

SEQ ID NO: 4883 - DNA, 21 bp, Artificial Sequence
  Description of Artificial Sequence: Synthetic oligonucleotide
  Description of Combined DNA/RNA Molecule: Synthetic oligonucleotide
acaattattttaataccctct

SEQ ID NO: 4884 - DNA, 21 bp, Artificial Sequence
  Description of Artificial Sequence: Synthetic oligonucleotide
  Description of Combined DNA/RNA Molecule: Synthetic oligonucleotide
caattattttaataccctctg

SEQ ID NO: 4885 - DNA, 21 bp, Artificial Sequence
  Description of Artificial Sequence: Synthetic oligonucleotide
  Description of Combined DNA/RNA Molecule: Synthetic oligonucleotide
aattattttaataccctctga

SEQ ID NO: 4886 - DNA, 21 bp, Artificial Sequence
  Description of Artificial Sequence: Synthetic oligonucleotide
  Description of Combined DNA/RNA Molecule: Synthetic oligonucleotide
ttattttaataccctctgatt

SEQ ID NO: 4887 - DNA, 21 bp, Artificial Sequence
  Description of Artificial Sequence: Synthetic oligonucleotide
  Description of Combined DNA/RNA Molecule: Synthetic oligonucleotide
tattttaataccctctgattt

SEQ ID NO: 4888 - DNA, 21 bp, Artificial Sequence
  Description of Artificial Sequence: Synthetic oligonucleotide
  Description of Combined DNA/RNA Molecule: Synthetic oligonucleotide
gctggggcaatcaatggatga

SEQ ID NO: 4889 - DNA, 21 bp, Artificial Sequence
  Description of Artificial Sequence: Synthetic oligonucleotide
  Description of Combined DNA/RNA Molecule: Synthetic oligonucleotide
ggcaatcaatggatgaaagtg

SEQ ID NO: 4890 - DNA, 21 bp, Artificial Sequence
  Description of Artificial Sequence: Synthetic oligonucleotide
  Description of Combined DNA/RNA Molecule: Synthetic oligonucleotide
ccagttatgattgtgaagtta

SEQ ID NO: 4891 - DNA, 21 bp, Artificial Sequence
  Description of Artificial Sequence: Synthetic oligonucleotide
  Description of Combined DNA/RNA Molecule: Synthetic oligonucleotide
cagttatgattgtgaagttaa

SEQ ID NO: 4892 - DNA, 21 bp, Artificial Sequence
  Description of Artificial Sequence: Synthetic oligonucleotide
  Description of Combined DNA/RNA Molecule: Synthetic oligonucleotide
attgtgaagttaatgctccta

SEQ ID NO: 4893 - DNA, 21 bp, Artificial Sequence
  Description of Artificial Sequence: Synthetic oligonucleotide
  Description of Combined DNA/RNA Molecule: Synthetic oligonucleotide
tgaagttaatgctcctataca

SEQ ID NO: 4894 - DNA, 21 bp, Artificial Sequence
  Description of Artificial Sequence: Synthetic oligonucleotide
  Description of Combined DNA/RNA Molecule: Synthetic oligonucleotide
gcagggtgaagaattactcag

SEQ ID NO: 4895 - DNA, 21 bp, Artificial Sequence
  Description of Artificial Sequence: Synthetic oligonucleotide
  Description of Combined DNA/RNA Molecule: Synthetic oligonucleotide
tgaagaattactcagagcttt

SEQ ID NO: 4896 - DNA, 21 bp, Artificial Sequence
  Description of Artificial Sequence: Synthetic oligonucleotide
  Description of Combined DNA/RNA Molecule: Synthetic oligonucleotide
aagaattactcagagctttgg

SEQ ID NO: 4897 - DNA, 21 bp, Artificial Sequence
  Description of Artificial Sequence: Synthetic oligonucleotide
  Description of Combined DNA/RNA Molecule: Synthetic oligonucleotide
ctcagagctttggatcaagtt

SEQ ID NO: 4898 - DNA, 21 bp, Artificial Sequence
  Description of Artificial Sequence: Synthetic oligonucleotide
  Description of Combined DNA/RNA Molecule: Synthetic oligonucleotide
caagttaactgagctttttct

SEQ ID NO: 4899 - DNA, 21 bp, Artificial Sequence
  Description of Artificial Sequence: Synthetic oligonucleotide
  Description of Combined DNA/RNA Molecule: Synthetic oligonucleotide
agttaactgagctttttctta

SEQ ID NO: 4900 - DNA, 21 bp, Artificial Sequence
  Description of Artificial Sequence: Synthetic oligonucleotide
  Description of Combined DNA/RNA Molecule: Synthetic oligonucleotide
ctttttcttaatttcattcct

SEQ ID NO: 4901 - DNA, 21 bp, Artificial Sequence
  Description of Artificial Sequence: Synthetic oligonucleotide
  Description of Combined DNA/RNA Molecule: Synthetic oligonucleotide
tcttaatttcattcctttttt

SEQ ID NO: 4902 - DNA, 21 bp, Artificial Sequence
  Description of Artificial Sequence: Synthetic oligonucleotide
  Description of Combined DNA/RNA Molecule: Synthetic oligonucleotide
ttaatttcattcctttttttg

SEQ ID NO: 4903 - DNA, 21 bp, Artificial Sequence
  Description of Artificial Sequence: Synthetic oligonucleotide
  Description of Combined DNA/RNA Molecule: Synthetic oligonucleotide
cactggtggctcattacctaa

SEQ ID NO: 4904 - DNA, 21 bp, Artificial Sequence
  Description of Artificial Sequence: Synthetic oligonucleotide
  Description of Combined DNA/RNA Molecule: Synthetic oligonucleotide
ctcattacctaaagcagtcta

SEQ ID NO: 4905 - DNA, 21 bp, Artificial Sequence
  Description of Artificial Sequence: Synthetic oligonucleotide
  Description of Combined DNA/RNA Molecule: Synthetic oligonucleotide
tcattacctaaagcagtctat

SEQ ID NO: 4906 - DNA, 21 bp, Artificial Sequence
  Description of Artificial Sequence: Synthetic oligonucleotide
  Description of Combined DNA/RNA Molecule: Synthetic oligonucleotide
acctaaagcagtctatttata

SEQ ID NO: 4907 - DNA, 21 bp, Artificial Sequence
  Description of Artificial Sequence: Synthetic oligonucleotide
  Description of Combined DNA/RNA Molecule: Synthetic oligonucleotide
ctaaagcagtctatttatatt

SEQ ID NO: 4908 - DNA, 21 bp, Artificial Sequence
  Description of Artificial Sequence: Synthetic oligonucleotide
  Description of Combined DNA/RNA Molecule: Synthetic oligonucleotide
tatttatattttctacatcta

SEQ ID NO: 4909 - DNA, 21 bp, Artificial Sequence
  Description of Artificial Sequence: Synthetic oligonucleotide
  Description of Combined DNA/RNA Molecule: Synthetic oligonucleotide
atttatattttctacatctaa

SEQ ID NO: 4910 - DNA, 21 bp, Artificial Sequence
  Description of Artificial Sequence: Synthetic oligonucleotide
  Description of Combined DNA/RNA Molecule: Synthetic oligonucleotide
tttatattttctacatctaat

SEQ ID NO: 4911 - DNA, 21 bp, Artificial Sequence
  Description of Artificial Sequence: Synthetic oligonucleotide
  Description of Combined DNA/RNA Molecule: Synthetic oligonucleotide
tatattttctacatctaattt

SEQ ID NO: 4912 - DNA, 21 bp, Artificial Sequence
  Description of Artificial Sequence: Synthetic oligonucleotide
  Description of Combined DNA/RNA Molecule: Synthetic oligonucleotide
atattttctacatctaatttt

SEQ ID NO: 4913 - DNA, 21 bp, Artificial Sequence
  Description of Artificial Sequence: Synthetic oligonucleotide
  Description of Combined DNA/RNA Molecule: Synthetic oligonucleotide
gcctggctacaatactgcaca

SEQ ID NO: 4914 - DNA, 21 bp, Artificial Sequence
  Description of Artificial Sequence: Synthetic oligonucleotide
  Description of Combined DNA/RNA Molecule: Synthetic oligonucleotide
aacttggttagttcaattttg

SEQ ID NO: 4915 - DNA, 21 bp, Artificial Sequence
  Description of Artificial Sequence: Synthetic oligonucleotide
  Description of Combined DNA/RNA Molecule: Synthetic oligonucleotide
ttagttcaattttgatcccct

SEQ ID NO: 4916 - DNA, 21 bp, Artificial Sequence
  Description of Artificial Sequence: Synthetic oligonucleotide
  Description of Combined DNA/RNA Molecule: Synthetic oligonucleotide
attttgatcccctttctactt

SEQ ID NO: 4917 - DNA, 21 bp, Artificial Sequence
  Description of Artificial Sequence: Synthetic oligonucleotide
  Description of Combined DNA/RNA Molecule: Synthetic oligonucleotide
ttttgatcccctttctactta

SEQ ID NO: 4918 - DNA, 21 bp, Artificial Sequence
  Description of Artificial Sequence: Synthetic oligonucleotide
  Description of Combined DNA/RNA Molecule: Synthetic oligonucleotide
tttgatcccctttctacttaa

SEQ ID NO: 4919 - DNA, 21 bp, Artificial Sequence
  Description of Artificial Sequence: Synthetic oligonucleotide
  Description of Combined DNA/RNA Molecule: Synthetic oligonucleotide
ccctttctacttaatttacat

SEQ ID NO: 4920 - DNA, 21 bp, Artificial Sequence
  Description of Artificial Sequence: Synthetic oligonucleotide
  Description of Combined DNA/RNA Molecule: Synthetic oligonucleotide
ttaatttacattaatgctctt

SEQ ID NO: 4921 - DNA, 21 bp, Artificial Sequence
  Description of Artificial Sequence: Synthetic oligonucleotide
  Description of Combined DNA/RNA Molecule: Synthetic oligonucleotide
taatttacattaatgctcttt

SEQ ID NO: 4922 - DNA, 21 bp, Artificial Sequence
  Description of Artificial Sequence: Synthetic oligonucleotide
  Description of Combined DNA/RNA Molecule: Synthetic oligonucleotide
acattaatgctcttttttagt

SEQ ID NO: 4923 - DNA, 21 bp, Artificial Sequence
  Description of Artificial Sequence: Synthetic oligonucleotide
  Description of Combined DNA/RNA Molecule: Synthetic oligonucleotide
cattaatgctcttttttagta

SEQ ID NO: 4924 - DNA, 21 bp, Artificial Sequence
  Description of Artificial Sequence: Synthetic oligonucleotide
  Description of Combined DNA/RNA Molecule: Synthetic oligonucleotide
ttaatgctcttttttagtatg

SEQ ID NO: 4925 - DNA, 21 bp, Artificial Sequence
  Description of Artificial Sequence: Synthetic oligonucleotide
  Description of Combined DNA/RNA Molecule: Synthetic oligonucleotide
cttttttagtatgttctttaa

SEQ ID NO: 4926 - DNA, 21 bp, Artificial Sequence
  Description of Artificial Sequence: Synthetic oligonucleotide
  Description of Combined DNA/RNA Molecule: Synthetic oligonucleotide
tttagtatgttctttaatgct

SEQ ID NO: 4927 - DNA, 21 bp, Artificial Sequence
  Description of Artificial Sequence: Synthetic oligonucleotide
  Description of Combined DNA/RNA Molecule: Synthetic oligonucleotide
ttagtatgttctttaatgctg

SEQ ID NO: 4928 - DNA, 21 bp, Artificial Sequence
  Description of Artificial Sequence: Synthetic oligonucleotide
  Description of Combined DNA/RNA Molecule: Synthetic oligonucleotide
tagtatgttctttaatgctgg

SEQ ID NO: 4929 - DNA, 21 bp, Artificial Sequence
  Description of Artificial Sequence: Synthetic oligonucleotide
  Description of Combined DNA/RNA Molecule: Synthetic oligonucleotide
cacagacagctcattttctca

SEQ ID NO: 4930 - DNA, 21 bp, Artificial Sequence
  Description of Artificial Sequence: Synthetic oligonucleotide
  Description of Combined DNA/RNA Molecule: Synthetic oligonucleotide
ctcattttctcagttttttgg

SEQ ID NO: 4931 - DNA, 21 bp, Artificial Sequence
  Description of Artificial Sequence: Synthetic oligonucleotide
  Description of Combined DNA/RNA Molecule: Synthetic oligonucleotide
tcattttctcagttttttggt

SEQ ID NO: 4932 - DNA, 21 bp, Artificial Sequence
  Description of Artificial Sequence: Synthetic oligonucleotide
  Description of Combined DNA/RNA Molecule: Synthetic oligonucleotide
cattttctcagttttttggta

SEQ ID NO: 4933 - DNA, 21 bp, Artificial Sequence
  Description of Artificial Sequence: Synthetic oligonucleotide
  Description of Combined DNA/RNA Molecule: Synthetic oligonucleotide
gttttttggtatttaaaccat

SEQ ID NO: 4934 - DNA, 21 bp, Artificial Sequence
  Description of Artificial Sequence: Synthetic oligonucleotide
  Description of Combined DNA/RNA Molecule: Synthetic oligonucleotide
tttggtatttaaaccattgca

SEQ ID NO: 4935 - DNA, 21 bp, Artificial Sequence
  Description of Artificial Sequence: Synthetic oligonucleotide
  Description of Combined DNA/RNA Molecule: Synthetic oligonucleotide
ttggtatttaaaccattgcat

SEQ ID NO: 4936 - DNA, 21 bp, Artificial Sequence
  Description of Artificial Sequence: Synthetic oligonucleotide
  Description of Combined DNA/RNA Molecule: Synthetic oligonucleotide
atttaaaccattgcattgcag

SEQ ID NO: 4937 - DNA, 21 bp, Artificial Sequence
  Description of Artificial Sequence: Synthetic oligonucleotide
  Description of Combined DNA/RNA Molecule: Synthetic oligonucleotide
gcattgcagtagcatcatttt

SEQ ID NO: 4938 - DNA, 21 bp, Artificial Sequence
  Description of Artificial Sequence: Synthetic oligonucleotide
  Description of Combined DNA/RNA Molecule: Synthetic oligonucleotide
gcagtagcatcattttaaaaa

SEQ ID NO: 4939 - DNA, 21 bp, Artificial Sequence
  Description of Artificial Sequence: Synthetic oligonucleotide
  Description of Combined DNA/RNA Molecule: Synthetic oligonucleotide
cagtagcatcattttaaaaaa

SEQ ID NO: 4940 - DNA, 21 bp, Artificial Sequence
  Description of Artificial Sequence: Synthetic oligonucleotide
  Description of Combined DNA/RNA Molecule: Synthetic oligonucleotide
atcattttaaaaaatgcacct

SEQ ID NO: 4941 - DNA, 21 bp, Artificial Sequence
  Description of Artificial Sequence: Synthetic oligonucleotide
  Description of Combined DNA/RNA Molecule: Synthetic oligonucleotide
tcattttaaaaaatgcacctt

SEQ ID NO: 4942 - DNA, 21 bp, Artificial Sequence
  Description of Artificial Sequence: Synthetic oligonucleotide
  Description of Combined DNA/RNA Molecule: Synthetic oligonucleotide
cattttaaaaaatgcaccttt

SEQ ID NO: 4943 - DNA, 21 bp, Artificial Sequence
  Description of Artificial Sequence: Synthetic oligonucleotide
  Description of Combined DNA/RNA Molecule: Synthetic oligonucleotide
attttaaaaaatgcacctttt

SEQ ID NO: 4944 - DNA, 21 bp, Artificial Sequence
  Description of Artificial Sequence: Synthetic oligonucleotide
  Description of Combined DNA/RNA Molecule: Synthetic oligonucleotide
ttttaaaaaatgcaccttttt

SEQ ID NO: 4945 - DNA, 21 bp, Artificial Sequence
  Description of Artificial Sequence: Synthetic oligonucleotide
  Description of Combined DNA/RNA Molecule: Synthetic oligonucleotide
tttaaaaaatgcaccttttta

SEQ ID NO: 4946 - DNA, 21 bp, Artificial Sequence
  Description of Artificial Sequence: Synthetic oligonucleotide
  Description of Combined DNA/RNA Molecule: Synthetic oligonucleotide
taaaaaatgcacctttttatt

SEQ ID NO: 4947 - DNA, 21 bp, Artificial Sequence
  Description of Artificial Sequence: Synthetic oligonucleotide
  Description of Combined DNA/RNA Molecule: Synthetic oligonucleotide
aaaaatgcacctttttattta

SEQ ID NO: 4948 - DNA, 21 bp, Artificial Sequence
  Description of Artificial Sequence: Synthetic oligonucleotide
  Description of Combined DNA/RNA Molecule: Synthetic oligonucleotide
acctttttatttatttatttt

SEQ ID NO: 4949 - DNA, 21 bp, Artificial Sequence
  Description of Artificial Sequence: Synthetic oligonucleotide
  Description of Combined DNA/RNA Molecule: Synthetic oligonucleotide
ttatttatttatttttggcta

SEQ ID NO: 4950 - DNA, 21 bp, Artificial Sequence
  Description of Artificial Sequence: Synthetic oligonucleotide
  Description of Combined DNA/RNA Molecule: Synthetic oligonucleotide
atttatttatttttggctagg

SEQ ID NO: 4951 - DNA, 21 bp, Artificial Sequence
  Description of Artificial Sequence: Synthetic oligonucleotide
  Description of Combined DNA/RNA Molecule: Synthetic oligonucleotide
tttatttatttttggctaggg

SEQ ID NO: 4952 - DNA, 21 bp, Artificial Sequence
  Description of Artificial Sequence: Synthetic oligonucleotide
  Description of Combined DNA/RNA Molecule: Synthetic oligonucleotide
ttatttatttttggctaggga

SEQ ID NO: 4953 - DNA, 21 bp, Artificial Sequence
  Description of Artificial Sequence: Synthetic oligonucleotide
  Description of Combined DNA/RNA Molecule: Synthetic oligonucleotide
tatttatttttggctagggag

SEQ ID NO: 4954 - DNA, 21 bp, Artificial Sequence
  Description of Artificial Sequence: Synthetic oligonucleotide
  Description of Combined DNA/RNA Molecule: Synthetic oligonucleotide
agggagtttatccctttttcg

SEQ ID NO: 4955 - DNA, 21 bp, Artificial Sequence
  Description of Artificial Sequence: Synthetic oligonucleotide
  Description of Combined DNA/RNA Molecule: Synthetic oligonucleotide
gggagtttatccctttttcga

SEQ ID NO: 4956 - DNA, 21 bp, Artificial Sequence
  Description of Artificial Sequence: Synthetic oligonucleotide
  Description of Combined DNA/RNA Molecule: Synthetic oligonucleotide
ggagtttatccctttttcgaa

SEQ ID NO: 4957 - DNA, 21 bp, Artificial Sequence
  Description of Artificial Sequence: Synthetic oligonucleotide
  Description of Combined DNA/RNA Molecule: Synthetic oligonucleotide
gagtttatccctttttcgaat

SEQ ID NO: 4958 - DNA, 21 bp, Artificial Sequence
  Description of Artificial Sequence: Synthetic oligonucleotide
  Description of Combined DNA/RNA Molecule: Synthetic oligonucleotide
agtttatccctttttcgaatt

SEQ ID NO: 4959 - DNA, 21 bp, Artificial Sequence
  Description of Artificial Sequence: Synthetic oligonucleotide
  Description of Combined DNA/RNA Molecule: Synthetic oligonucleotide
gtttatccctttttcgaatta

SEQ ID NO: 4960 - DNA, 21 bp, Artificial Sequence
  Description of Artificial Sequence: Synthetic oligonucleotide
  Description of Combined DNA/RNA Molecule: Synthetic oligonucleotide
ttcgaattatttttaagaaga

SEQ ID NO: 4961 - DNA, 21 bp, Artificial Sequence
  Description of Artificial Sequence: Synthetic oligonucleotide
  Description of Combined DNA/RNA Molecule: Synthetic oligonucleotide
attatttttaagaagatgcca

SEQ ID NO: 4962 - DNA, 21 bp, Artificial Sequence
  Description of Artificial Sequence: Synthetic oligonucleotide
  Description of Combined DNA/RNA Molecule: Synthetic oligonucleotide
ttatttttaagaagatgccaa

SEQ ID NO: 4963 - DNA, 21 bp, Artificial Sequence
  Description of Artificial Sequence: Synthetic oligonucleotide
  Description of Combined DNA/RNA Molecule: Synthetic oligonucleotide
atttttaagaagatgccaata

SEQ ID NO: 4964 - DNA, 21 bp, Artificial Sequence
  Description of Artificial Sequence: Synthetic oligonucleotide
  Description of Combined DNA/RNA Molecule: Synthetic oligonucleotide
tttttaagaagatgccaatat

SEQ ID NO: 4965 - DNA, 21 bp, Artificial Sequence
  Description of Artificial Sequence: Synthetic oligonucleotide
  Description of Combined DNA/RNA Molecule: Synthetic oligonucleotide
tttaagaagatgccaatataa

SEQ ID NO: 4966 - DNA, 21 bp, Artificial Sequence
  Description of Artificial Sequence: Synthetic oligonucleotide
  Description of Combined DNA/RNA Molecule: Synthetic oligonucleotide
ttaagaagatgccaatataat

SEQ ID NO: 4967 - DNA, 21 bp, Artificial Sequence
  Description of Artificial Sequence: Synthetic oligonucleotide
  Description of Combined DNA/RNA Molecule: Synthetic oligonucleotide
aagaagatgccaatataattt

SEQ ID NO: 4968 - DNA, 21 bp, Artificial Sequence
  Description of Artificial Sequence: Synthetic oligonucleotide
  Description of Combined DNA/RNA Molecule: Synthetic oligonucleotide
agaagatgccaatataatttt

SEQ ID NO: 4969 - DNA, 21 bp, Artificial Sequence
  Description of Artificial Sequence: Synthetic oligonucleotide
  Description of Combined DNA/RNA Molecule: Synthetic oligonucleotide
gaagatgccaatataattttt

SEQ ID NO: 4970 - DNA, 21 bp, Artificial Sequence
  Description of Artificial Sequence: Synthetic oligonucleotide
  Description of Combined DNA/RNA Molecule: Synthetic oligonucleotide
ccaatataatttttgtaagaa

SEQ ID NO: 4971 - DNA, 21 bp, Artificial Sequence
  Description of Artificial Sequence: Synthetic oligonucleotide
  Description of Combined DNA/RNA Molecule: Synthetic oligonucleotide
tataatttttgtaagaaggca

SEQ ID NO: 4972 - DNA, 21 bp, Artificial Sequence
  Description of Artificial Sequence: Synthetic oligonucleotide
  Description of Combined DNA/RNA Molecule: Synthetic oligonucleotide
taatttttgtaagaaggcagt

SEQ ID NO: 4973 - DNA, 21 bp, Artificial Sequence
  Description of Artificial Sequence: Synthetic oligonucleotide
  Description of Combined DNA/RNA Molecule: Synthetic oligonucleotide
atcatgatcataggcagttga

SEQ ID NO: 4974 - DNA, 21 bp, Artificial Sequence
  Description of Artificial Sequence: Synthetic oligonucleotide
  Description of Combined DNA/RNA Molecule: Synthetic oligonucleotide
catgatcataggcagttgaaa

SEQ ID NO: 4975 - DNA, 21 bp, Artificial Sequence
  Description of Artificial Sequence: Synthetic oligonucleotide
  Description of Combined DNA/RNA Molecule: Synthetic oligonucleotide
atcataggcagttgaaaaatt

SEQ ID NO: 4976 - DNA, 21 bp, Artificial Sequence
  Description of Artificial Sequence: Synthetic oligonucleotide
  Description of Combined DNA/RNA Molecule: Synthetic oligonucleotide
cataggcagttgaaaaatttt

SEQ ID NO: 4977 - DNA, 21 bp, Artificial Sequence
  Description of Artificial Sequence: Synthetic oligonucleotide
  Description of Combined DNA/RNA Molecule: Synthetic oligonucleotide
gttgaaaaatttttacacctt

SEQ ID NO: 4978 - DNA, 21 bp, Artificial Sequence
  Description of Artificial Sequence: Synthetic oligonucleotide
  Description of Combined DNA/RNA Molecule: Synthetic oligonucleotide
ttgaaaaatttttacaccttt

SEQ ID NO: 4979 - DNA, 21 bp, Artificial Sequence
  Description of Artificial Sequence: Synthetic oligonucleotide
  Description of Combined DNA/RNA Molecule: Synthetic oligonucleotide
tgaaaaatttttacacctttt

SEQ ID NO: 4980 - DNA, 21 bp, Artificial Sequence
  Description of Artificial Sequence: Synthetic oligonucleotide
  Description of Combined DNA/RNA Molecule: Synthetic oligonucleotide
gaaaaatttttacaccttttt

SEQ ID NO: 4981 - DNA, 21 bp, Artificial Sequence
  Description of Artificial Sequence: Synthetic oligonucleotide
  Description of Combined DNA/RNA Molecule: Synthetic oligonucleotide
aaaaatttttacacctttttt

SEQ ID NO: 4982 - DNA, 21 bp, Artificial Sequence
  Description of Artificial Sequence: Synthetic oligonucleotide
  Description of Combined DNA/RNA Molecule: Synthetic oligonucleotide
cttttttttcacattttacat

SEQ ID NO: 4983 - DNA, 21 bp, Artificial Sequence
  Description of Artificial Sequence: Synthetic oligonucleotide
  Description of Combined DNA/RNA Molecule: Synthetic oligonucleotide
ttttttttcacattttacata

SEQ ID NO: 4984 - DNA, 21 bp, Artificial Sequence
  Description of Artificial Sequence: Synthetic oligonucleotide
  Description of Combined DNA/RNA Molecule: Synthetic oligonucleotide
tttttttcacattttacataa

SEQ ID NO: 4985 - DNA, 21 bp, Artificial Sequence
  Description of Artificial Sequence: Synthetic oligonucleotide
  Description of Combined DNA/RNA Molecule: Synthetic oligonucleotide
ttttttcacattttacataaa

SEQ ID NO: 4986 - DNA, 21 bp, Artificial Sequence
  Description of Artificial Sequence: Synthetic oligonucleotide
  Description of Combined DNA/RNA Molecule: Synthetic oligonucleotide
cacattttacataaataataa

SEQ ID NO: 4987 - DNA, 21 bp, Artificial Sequence
  Description of Artificial Sequence: Synthetic oligonucleotide
  Description of Combined DNA/RNA Molecule: Synthetic oligonucleotide
tggtagccacaattgcacaat

SEQ ID NO: 4988 - DNA, 21 bp, Artificial Sequence
  Description of Artificial Sequence: Synthetic oligonucleotide
  Description of Combined DNA/RNA Molecule: Synthetic oligonucleotide
acaatatattttcttaaaaaa

SEQ ID NO: 4989 - DNA, 21 bp, Artificial Sequence
  Description of Artificial Sequence: Synthetic oligonucleotide
  Description of Combined DNA/RNA Molecule: Synthetic oligonucleotide
ttcttaaaaaataccagcagt

SEQ ID NO: 4990 - DNA, 21 bp, Artificial Sequence
  Description of Artificial Sequence: Synthetic oligonucleotide
  Description of Combined DNA/RNA Molecule: Synthetic oligonucleotide
agcagttactcatggaatata

SEQ ID NO: 4991 - DNA, 21 bp, Artificial Sequence
  Description of Artificial Sequence: Synthetic oligonucleotide
  Description of Combined DNA/RNA Molecule: Synthetic oligonucleotide
ctcatggaatatattctgcgt

SEQ ID NO: 4992 - DNA, 21 bp, Artificial Sequence
  Description of Artificial Sequence: Synthetic oligonucleotide
  Description of Combined DNA/RNA Molecule: Synthetic oligonucleotide
tcatggaatatattctgcgtt

SEQ ID NO: 4993 - DNA, 21 bp, Artificial Sequence
  Description of Artificial Sequence: Synthetic oligonucleotide
  Description of Combined DNA/RNA Molecule: Synthetic oligonucleotide
catggaatatattctgcgttt

SEQ ID NO: 4994 - DNA, 21 bp, Artificial Sequence
  Description of Artificial Sequence: Synthetic oligonucleotide
  Description of Combined DNA/RNA Molecule: Synthetic oligonucleotide
atggaatatattctgcgttta

SEQ ID NO: 4995 - DNA, 21 bp, Artificial Sequence
  Description of Artificial Sequence: Synthetic oligonucleotide
  Description of Combined DNA/RNA Molecule: Synthetic oligonucleotide
tggaatatattctgcgtttat

SEQ ID NO: 4996 - DNA, 21 bp, Artificial Sequence
  Description of Artificial Sequence: Synthetic oligonucleotide
  Description of Combined DNA/RNA Molecule: Synthetic oligonucleotide
ggaatatattctgcgtttata

SEQ ID NO: 4997 - DNA, 21 bp, Artificial Sequence
  Description of Artificial Sequence: Synthetic oligonucleotide
  Description of Combined DNA/RNA Molecule: Synthetic oligonucleotide
gaatatattctgcgtttataa

SEQ ID NO: 4998 - DNA, 21 bp, Artificial Sequence
  Description of Artificial Sequence: Synthetic oligonucleotide
  Description of Combined DNA/RNA Molecule: Synthetic oligonucleotide
ttataaaactagtttttaaga

SEQ ID NO: 4999 - DNA, 21 bp, Artificial Sequence
  Description of Artificial Sequence: Synthetic oligonucleotide
  Description of Combined DNA/RNA Molecule: Synthetic oligonucleotide
aactagtttttaagaagaaat

SEQ ID NO: 5000 - DNA, 21 bp, Artificial Sequence
  Description of Artificial Sequence: Synthetic oligonucleotide
  Description of Combined DNA/RNA Molecule: Synthetic oligonucleotide
actagtttttaagaagaaatt

SEQ ID NO: 5001 - DNA, 21 bp, Artificial Sequence
  Description of Artificial Sequence: Synthetic oligonucleotide
  Description of Combined DNA/RNA Molecule: Synthetic oligonucleotide
ctagtttttaagaagaaattt

SEQ ID NO: 5002 - DNA, 21 bp, Artificial Sequence
  Description of Artificial Sequence: Synthetic oligonucleotide
  Description of Combined DNA/RNA Molecule: Synthetic oligonucleotide
tagtttttaagaagaaatttt

SEQ ID NO: 5003 - DNA, 21 bp, Artificial Sequence
  Description of Artificial Sequence: Synthetic oligonucleotide
  Description of Combined DNA/RNA Molecule: Synthetic oligonucleotide
tttttaagaagaaattttttt

SEQ ID NO: 5004 - DNA, 21 bp, Artificial Sequence
  Description of Artificial Sequence: Synthetic oligonucleotide
  Description of Combined DNA/RNA Molecule: Synthetic oligonucleotide
agaagaaattttttttggcct

SEQ ID NO: 5005 - DNA, 21 bp, Artificial Sequence
  Description of Artificial Sequence: Synthetic oligonucleotide
  Description of Combined DNA/RNA Molecule: Synthetic oligonucleotide
aagaaattttttttggcctat

SEQ ID NO: 5006 - DNA, 21 bp, Artificial Sequence
  Description of Artificial Sequence: Synthetic oligonucleotide
  Description of Combined DNA/RNA Molecule: Synthetic oligonucleotide
gaaattttttttggcctatga

SEQ ID NO: 5007 - DNA, 21 bp, Artificial Sequence
  Description of Artificial Sequence: Synthetic oligonucleotide
  Description of Combined DNA/RNA Molecule: Synthetic oligonucleotide
aattttttttggcctatgaaa

SEQ ID NO: 5008 - DNA, 21 bp, Artificial Sequence
  Description of Artificial Sequence: Synthetic oligonucleotide
  Description of Combined DNA/RNA Molecule: Synthetic oligonucleotide
tttttttggcctatgaaattg

SEQ ID NO: 5009 - DNA, 21 bp, Artificial Sequence
  Description of Artificial Sequence: Synthetic oligonucleotide
  Description of Combined DNA/RNA Molecule: Synthetic oligonucleotide
ttttttggcctatgaaattgt

SEQ ID NO: 5010 - DNA, 21 bp, Artificial Sequence
  Description of Artificial Sequence: Synthetic oligonucleotide
  Description of Combined DNA/RNA Molecule: Synthetic oligonucleotide
tttttggcctatgaaattgtt

SEQ ID NO: 5011 - DNA, 21 bp, Artificial Sequence
  Description of Artificial Sequence: Synthetic oligonucleotide
  Description of Combined DNA/RNA Molecule: Synthetic oligonucleotide
ttttggcctatgaaattgtta

SEQ ID NO: 5012 - DNA, 21 bp, Artificial Sequence
  Description of Artificial Sequence: Synthetic oligonucleotide
  Description of Combined DNA/RNA Molecule: Synthetic oligonucleotide
gcctatgaaattgttaaacct

SEQ ID NO: 5013 - DNA, 21 bp, Artificial Sequence
  Description of Artificial Sequence: Synthetic oligonucleotide
  Description of Combined DNA/RNA Molecule: Synthetic oligonucleotide
ctatgaaattgttaaacctgg

SEQ ID NO: 5014 - DNA, 21 bp, Artificial Sequence
  Description of Artificial Sequence: Synthetic oligonucleotide
  Description of Combined DNA/RNA Molecule: Synthetic oligonucleotide
gaaattgttaaacctggaaca

SEQ ID NO: 5015 - DNA, 21 bp, Artificial Sequence
  Description of Artificial Sequence: Synthetic oligonucleotide
  Description of Combined DNA/RNA Molecule: Synthetic oligonucleotide
aaattgttaaacctggaacat

SEQ ID NO: 5016 - DNA, 21 bp, Artificial Sequence
  Description of Artificial Sequence: Synthetic oligonucleotide
  Description of Combined DNA/RNA Molecule: Synthetic oligonucleotide
acctggaacatgacattgtta

SEQ ID NO: 5017 - DNA, 21 bp, Artificial Sequence
  Description of Artificial Sequence: Synthetic oligonucleotide
  Description of Combined DNA/RNA Molecule: Synthetic oligonucleotide
aacatgacattgttaatcata

SEQ ID NO: 5018 - DNA, 21 bp, Artificial Sequence
  Description of Artificial Sequence: Synthetic oligonucleotide
  Description of Combined DNA/RNA Molecule: Synthetic oligonucleotide
acatgacattgttaatcatat

SEQ ID NO: 5019 - DNA, 21 bp, Artificial Sequence
  Description of Artificial Sequence: Synthetic oligonucleotide
  Description of Combined DNA/RNA Molecule: Synthetic oligonucleotide
gacattgttaatcatataata

SEQ ID NO: 5020 - DNA, 21 bp, Artificial Sequence
  Description of Artificial Sequence: Synthetic oligonucleotide
  Description of Combined DNA/RNA Molecule: Synthetic oligonucleotide
cattgttaatcatataataat

SEQ ID NO: 5021 - DNA, 21 bp, Artificial Sequence
  Description of Artificial Sequence: Synthetic oligonucleotide
  Description of Combined DNA/RNA Molecule: Synthetic oligonucleotide
attgttaatcatataataatg

SEQ ID NO: 5022 - DNA, 21 bp, Artificial Sequence
  Description of Artificial Sequence: Synthetic oligonucleotide
  Description of Combined DNA/RNA Molecule: Synthetic oligonucleotide
ttgttaatcatataataatga

SEQ ID NO: 5023 - DNA, 21 bp, Artificial Sequence
  Description of Artificial Sequence: Synthetic oligonucleotide
  Description of Combined DNA/RNA Molecule: Synthetic oligonucleotide
tcatataataatgattcttaa

SEQ ID NO: 5024 - DNA, 21 bp, Artificial Sequence
  Description of Artificial Sequence: Synthetic oligonucleotide
  Description of Combined DNA/RNA Molecule: Synthetic oligonucleotide
catataataatgattcttaaa

SEQ ID NO: 5025 - DNA, 21 bp, Artificial Sequence
  Description of Artificial Sequence: Synthetic oligonucleotide
  Description of Combined DNA/RNA Molecule: Synthetic oligonucleotide
taataatgattcttaaatgct

SEQ ID NO: 5026 - DNA, 21 bp, Artificial Sequence
  Description of Artificial Sequence: Synthetic oligonucleotide
  Description of Combined DNA/RNA Molecule: Synthetic oligonucleotide
taatgattcttaaatgctgta

SEQ ID NO: 5027 - DNA, 21 bp, Artificial Sequence
  Description of Artificial Sequence: Synthetic oligonucleotide
  Description of Combined DNA/RNA Molecule: Synthetic oligonucleotide
aatgattcttaaatgctgtat

SEQ ID NO: 5028 - DNA, 21 bp, Artificial Sequence
  Description of Artificial Sequence: Synthetic oligonucleotide
  Description of Combined DNA/RNA Molecule: Synthetic oligonucleotide
atgattcttaaatgctgtatg

SEQ ID NO: 5029 - DNA, 21 bp, Artificial Sequence
  Description of Artificial Sequence: Synthetic oligonucleotide
  Description of Combined DNA/RNA Molecule: Synthetic oligonucleotide
tcttaaatgctgtatggttta

SEQ ID NO: 5030 - DNA, 21 bp, Artificial Sequence
  Description of Artificial Sequence: Synthetic oligonucleotide
  Description of Combined DNA/RNA Molecule: Synthetic oligonucleotide
cttaaatgctgtatggtttat

SEQ ID NO: 5031 - DNA, 21 bp, Artificial Sequence
  Description of Artificial Sequence: Synthetic oligonucleotide
  Description of Combined DNA/RNA Molecule: Synthetic oligonucleotide
taaatgctgtatggtttatta

SEQ ID NO: 5032 - DNA, 21 bp, Artificial Sequence
  Description of Artificial Sequence: Synthetic oligonucleotide
  Description of Combined DNA/RNA Molecule: Synthetic oligonucleotide
tgtatggtttattatttaaat

SEQ ID NO: 5033 - DNA, 21 bp, Artificial Sequence
  Description of Artificial Sequence: Synthetic oligonucleotide
  Description of Combined DNA/RNA Molecule: Synthetic oligonucleotide
tatggtttattatttaaatgg

SEQ ID NO: 5034 - DNA, 21 bp, Artificial Sequence
  Description of Artificial Sequence: Synthetic oligonucleotide
  Description of Combined DNA/RNA Molecule: Synthetic oligonucleotide
atggtttattatttaaatggg

SEQ ID NO: 5035 - DNA, 21 bp, Artificial Sequence
  Description of Artificial Sequence: Synthetic oligonucleotide
  Description of Combined DNA/RNA Molecule: Synthetic oligonucleotide
ggtttattatttaaatgggta

SEQ ID NO: 5036 - DNA, 21 bp, Artificial Sequence
  Description of Artificial Sequence: Synthetic oligonucleotide
  Description of Combined DNA/RNA Molecule: Synthetic oligonucleotide
gtttattatttaaatgggtaa

SEQ ID NO: 5037 - DNA, 21 bp, Artificial Sequence
  Description of Artificial Sequence: Synthetic oligonucleotide
  Description of Combined DNA/RNA Molecule: Synthetic oligonucleotide
ttatttaaatgggtaaagcca

SEQ ID NO: 5038 - DNA, 21 bp, Artificial Sequence
  Description of Artificial Sequence: Synthetic oligonucleotide
  Description of Combined DNA/RNA Molecule: Synthetic oligonucleotide
aaatgggtaaagccatttaca

SEQ ID NO: 5039 - DNA, 21 bp, Artificial Sequence
  Description of Artificial Sequence: Synthetic oligonucleotide
  Description of Combined DNA/RNA Molecule: Synthetic oligonucleotide
tgggtaaagccatttacataa

SEQ ID NO: 5040 - DNA, 21 bp, Artificial Sequence
  Description of Artificial Sequence: Synthetic oligonucleotide
  Description of Combined DNA/RNA Molecule: Synthetic oligonucleotide
ggtaaagccatttacataata

SEQ ID NO: 5041 - DNA, 21 bp, Artificial Sequence
  Description of Artificial Sequence: Synthetic oligonucleotide
  Description of Combined DNA/RNA Molecule: Synthetic oligonucleotide
gtaaagccatttacataatat

SEQ ID NO: 5042 - DNA, 21 bp, Artificial Sequence
  Description of Artificial Sequence: Synthetic oligonucleotide
  Description of Combined DNA/RNA Molecule: Synthetic oligonucleotide
gccatttacataatatagaaa

SEQ ID NO: 5043 - DNA, 21 bp, Artificial Sequence
  Description of Artificial Sequence: Synthetic oligonucleotide
  Description of Combined DNA/RNA Molecule: Synthetic oligonucleotide
ataatatagaaagatatgcat

SEQ ID NO: 5044 - DNA, 21 bp, Artificial Sequence
  Description of Artificial Sequence: Synthetic oligonucleotide
  Description of Combined DNA/RNA Molecule: Synthetic oligonucleotide
taatatagaaagatatgcata

SEQ ID NO: 5045 - DNA, 21 bp, Artificial Sequence
  Description of Artificial Sequence: Synthetic oligonucleotide
  Description of Combined DNA/RNA Molecule: Synthetic oligonucleotide
aatatagaaagatatgcatat

SEQ ID NO: 5046 - DNA, 21 bp, Artificial Sequence
  Description of Artificial Sequence: Synthetic oligonucleotide
  Description of Combined DNA/RNA Molecule: Synthetic oligonucleotide
tagaaagatatgcatatatct

SEQ ID NO: 5047 - DNA, 21 bp, Artificial Sequence
  Description of Artificial Sequence: Synthetic oligonucleotide
  Description of Combined DNA/RNA Molecule: Synthetic oligonucleotide
aaagatatgcatatatctaga

SEQ ID NO: 5048 - DNA, 21 bp, Artificial Sequence
  Description of Artificial Sequence: Synthetic oligonucleotide
  Description of Combined DNA/RNA Molecule: Synthetic oligonucleotide
aagatatgcatatatctagaa

SEQ ID NO: 5049 - DNA, 21 bp, Artificial Sequence
  Description of Artificial Sequence: Synthetic oligonucleotide
  Description of Combined DNA/RNA Molecule: Synthetic oligonucleotide
agatatgcatatatctagaag

SEQ ID NO: 5050 - DNA, 21 bp, Artificial Sequence
  Description of Artificial Sequence: Synthetic oligonucleotide
  Description of Combined DNA/RNA Molecule: Synthetic oligonucleotide
tgcatatatctagaaggtatg

SEQ ID NO: 5051 - DNA, 21 bp, Artificial Sequence
  Description of Artificial Sequence: Synthetic oligonucleotide
  Description of Combined DNA/RNA Molecule: Synthetic oligonucleotide
gcatatatctagaaggtatgt

SEQ ID NO: 5052 - DNA, 21 bp, Artificial Sequence
  Description of Artificial Sequence: Synthetic oligonucleotide
  Description of Combined DNA/RNA Molecule: Synthetic oligonucleotide
tctagaaggtatgtggcattt

SEQ ID NO: 5053 - DNA, 21 bp, Artificial Sequence
  Description of Artificial Sequence: Synthetic oligonucleotide
  Description of Combined DNA/RNA Molecule: Synthetic oligonucleotide
gaaggtatgtggcatttattt

SEQ ID NO: 5054 - DNA, 21 bp, Artificial Sequence
  Description of Artificial Sequence: Synthetic oligonucleotide
  Description of Combined DNA/RNA Molecule: Synthetic oligonucleotide
gtatgtggcatttatttggat

SEQ ID NO: 5055 - DNA, 21 bp, Artificial Sequence
  Description of Artificial Sequence: Synthetic oligonucleotide
  Description of Combined DNA/RNA Molecule: Synthetic oligonucleotide
atgtggcatttatttggataa

SEQ ID NO: 5056 - DNA, 21 bp, Artificial Sequence
  Description of Artificial Sequence: Synthetic oligonucleotide
  Description of Combined DNA/RNA Molecule: Synthetic oligonucleotide
tttatttggataaaattctca

SEQ ID NO: 5057 - DNA, 21 bp, Artificial Sequence
  Description of Artificial Sequence: Synthetic oligonucleotide
  Description of Combined DNA/RNA Molecule: Synthetic oligonucleotide
tggataaaattctcaattcag

SEQ ID NO: 5058 - DNA, 21 bp, Artificial Sequence
  Description of Artificial Sequence: Synthetic oligonucleotide
  Description of Combined DNA/RNA Molecule: Synthetic oligonucleotide
gataaaattctcaattcagag

SEQ ID NO: 5059 - DNA, 21 bp, Artificial Sequence
  Description of Artificial Sequence: Synthetic oligonucleotide
  Description of Combined DNA/RNA Molecule: Synthetic oligonucleotide
taaaattctcaattcagagaa

SEQ ID NO: 5060 - DNA, 21 bp, Artificial Sequence
  Description of Artificial Sequence: Synthetic oligonucleotide
  Description of Combined DNA/RNA Molecule: Synthetic oligonucleotide
tcaattcagagaaatcatctg

SEQ ID NO: 5061 - DNA, 21 bp, Artificial Sequence
  Description of Artificial Sequence: Synthetic oligonucleotide
  Description of Combined DNA/RNA Molecule: Synthetic oligonucleotide
ttcagagaaatcatctgatgt

SEQ ID NO: 5062 - DNA, 21 bp, Artificial Sequence
  Description of Artificial Sequence: Synthetic oligonucleotide
  Description of Combined DNA/RNA Molecule: Synthetic oligonucleotide
agaaatcatctgatgtttcta

SEQ ID NO: 5063 - DNA, 21 bp, Artificial Sequence
  Description of Artificial Sequence: Synthetic oligonucleotide
  Description of Combined DNA/RNA Molecule: Synthetic oligonucleotide
tctgatgtttctatagtcact

SEQ ID NO: 5064 - DNA, 21 bp, Artificial Sequence
  Description of Artificial Sequence: Synthetic oligonucleotide
  Description of Combined DNA/RNA Molecule: Synthetic oligonucleotide
ctgatgtttctatagtcactt

SEQ ID NO: 5065 - DNA, 21 bp, Artificial Sequence
  Description of Artificial Sequence: Synthetic oligonucleotide
  Description of Combined DNA/RNA Molecule: Synthetic oligonucleotide
tcaaaagaaaacaatacccta

SEQ ID NO: 5066 - DNA, 21 bp, Artificial Sequence
  Description of Artificial Sequence: Synthetic oligonucleotide
  Description of Combined DNA/RNA Molecule: Synthetic oligonucleotide
aaaagaaaacaataccctatg

SEQ ID NO: 5067 - DNA, 21 bp, Artificial Sequence
  Description of Artificial Sequence: Synthetic oligonucleotide
  Description of Combined DNA/RNA Molecule: Synthetic oligonucleotide
aaagaaaacaataccctatgt

SEQ ID NO: 5068 - DNA, 21 bp, Artificial Sequence
  Description of Artificial Sequence: Synthetic oligonucleotide
  Description of Combined DNA/RNA Molecule: Synthetic oligonucleotide
agaaaacaataccctatgtag

SEQ ID NO: 5069 - DNA, 21 bp, Artificial Sequence
  Description of Artificial Sequence: Synthetic oligonucleotide
  Description of Combined DNA/RNA Molecule: Synthetic oligonucleotide
aacaataccctatgtagttgt

SEQ ID NO: 5070 - DNA, 21 bp, Artificial Sequence
  Description of Artificial Sequence: Synthetic oligonucleotide
  Description of Combined DNA/RNA Molecule: Synthetic oligonucleotide
cctatgtagttgtggaagttt

SEQ ID NO: 5071 - DNA, 21 bp, Artificial Sequence
  Description of Artificial Sequence: Synthetic oligonucleotide
  Description of Combined DNA/RNA Molecule: Synthetic oligonucleotide
ctatgtagttgtggaagttta

SEQ ID NO: 5072 - DNA, 21 bp, Artificial Sequence
  Description of Artificial Sequence: Synthetic oligonucleotide
  Description of Combined DNA/RNA Molecule: Synthetic oligonucleotide
tagttgtggaagtttatgcta

SEQ ID NO: 5073 - DNA, 21 bp, Artificial Sequence
  Description of Artificial Sequence: Synthetic oligonucleotide
  Description of Combined DNA/RNA Molecule: Synthetic oligonucleotide
agttgtggaagtttatgctaa

SEQ ID NO: 5074 - DNA, 21 bp, Artificial Sequence
  Description of Artificial Sequence: Synthetic oligonucleotide
  Description of Combined DNA/RNA Molecule: Synthetic oligonucleotide
ttgtggaagtttatgctaata

SEQ ID NO: 5075 - DNA, 21 bp, Artificial Sequence
  Description of Artificial Sequence: Synthetic oligonucleotide
  Description of Combined DNA/RNA Molecule: Synthetic oligonucleotide
gtggaagtttatgctaatatt

SEQ ID NO: 5076 - DNA, 21 bp, Artificial Sequence
  Description of Artificial Sequence: Synthetic oligonucleotide
  Description of Combined DNA/RNA Molecule: Synthetic oligonucleotide
tggaagtttatgctaatattg

SEQ ID NO: 5077 - DNA, 21 bp, Artificial Sequence
  Description of Artificial Sequence: Synthetic oligonucleotide
  Description of Combined DNA/RNA Molecule: Synthetic oligonucleotide
ggaagtttatgctaatattgt

SEQ ID NO: 5078 - DNA, 21 bp, Artificial Sequence
  Description of Artificial Sequence: Synthetic oligonucleotide
  Description of Combined DNA/RNA Molecule: Synthetic oligonucleotide
aagtttatgctaatattgtgt

SEQ ID NO: 5079 - DNA, 21 bp, Artificial Sequence
  Description of Artificial Sequence: Synthetic oligonucleotide
  Description of Combined DNA/RNA Molecule: Synthetic oligonucleotide
tgctaatattgtgtaactgat

SEQ ID NO: 5080 - DNA, 21 bp, Artificial Sequence
  Description of Artificial Sequence: Synthetic oligonucleotide
  Description of Combined DNA/RNA Molecule: Synthetic oligonucleotide
ctaatattgtgtaactgatat

SEQ ID NO: 5081 - DNA, 21 bp, Artificial Sequence
  Description of Artificial Sequence: Synthetic oligonucleotide
  Description of Combined DNA/RNA Molecule: Synthetic oligonucleotide
aatattgtgtaactgatatta

SEQ ID NO: 5082 - DNA, 21 bp, Artificial Sequence
  Description of Artificial Sequence: Synthetic oligonucleotide
  Description of Combined DNA/RNA Molecule: Synthetic oligonucleotide
aactgatattaaacctaaatg

SEQ ID NO: 5083 - DNA, 21 bp, Artificial Sequence
  Description of Artificial Sequence: Synthetic oligonucleotide
  Description of Combined DNA/RNA Molecule: Synthetic oligonucleotide
ctgttggtataaagatatttt

SEQ ID NO: 5084 - DNA, 21 bp, Artificial Sequence
  Description of Artificial Sequence: Synthetic oligonucleotide
  Description of Combined DNA/RNA Molecule: Synthetic oligonucleotide
ggtataaagatattttgagca

SEQ ID NO: 5085 - DNA, 21 bp, Artificial Sequence
  Description of Artificial Sequence: Synthetic oligonucleotide
  Description of Combined DNA/RNA Molecule: Synthetic oligonucleotide
taaagatattttgagcagact

SEQ ID NO: 5086 - DNA, 21 bp, Artificial Sequence
  Description of Artificial Sequence: Synthetic oligonucleotide
  Description of Combined DNA/RNA Molecule: Synthetic oligonucleotide
aaagatattttgagcagactg

SEQ ID NO: 5087 - DNA, 21 bp, Artificial Sequence
  Description of Artificial Sequence: Synthetic oligonucleotide
  Description of Combined DNA/RNA Molecule: Synthetic oligonucleotide
aagatattttgagcagactgt

SEQ ID NO: 5088 - DNA, 21 bp, Artificial Sequence
  Description of Artificial Sequence: Synthetic oligonucleotide
  Description of Combined DNA/RNA Molecule: Synthetic oligonucleotide
attttgagcagactgtaaaca

SEQ ID NO: 5089 - DNA, 21 bp, Artificial Sequence
  Description of Artificial Sequence: Synthetic oligonucleotide
  Description of Combined DNA/RNA Molecule: Synthetic oligonucleotide
tttgagcagactgtaaacaag

SEQ ID NO: 5090 - DNA, 21 bp, Artificial Sequence
  Description of Artificial Sequence: Synthetic oligonucleotide
  Description of Combined DNA/RNA Molecule: Synthetic oligonucleotide
agcagactgtaaacaagaaaa

SEQ ID NO: 5091 - DNA, 21 bp, Artificial Sequence
  Description of Artificial Sequence: Synthetic oligonucleotide
  Description of Combined DNA/RNA Molecule: Synthetic oligonucleotide
gactgtaaacaagaaaaaaaa

SEQ ID NO: 5092 - DNA, 21 bp, Artificial Sequence
  Description of Artificial Sequence: Synthetic oligonucleotide
  Description of Combined DNA/RNA Molecule: Synthetic oligonucleotide
actgtaaacaagaaaaaaaaa

SEQ ID NO: 5093 - DNA, 21 bp, Artificial Sequence
  Description of Artificial Sequence: Synthetic oligonucleotide
  Description of Combined DNA/RNA Molecule: Synthetic oligonucleotide
aaaaaaaaaatcatgcattct

SEQ ID NO: 5094 - DNA, 21 bp, Artificial Sequence
  Description of Artificial Sequence: Synthetic oligonucleotide
  Description of Combined DNA/RNA Molecule: Synthetic oligonucleotide
aaaaaaaaatcatgcattctt

SEQ ID NO: 5095 - DNA, 21 bp, Artificial Sequence
  Description of Artificial Sequence: Synthetic oligonucleotide
  Description of Combined DNA/RNA Molecule: Synthetic oligonucleotide
atcatgcattcttagcaaaat

SEQ ID NO: 5096 - DNA, 21 bp, Artificial Sequence
  Description of Artificial Sequence: Synthetic oligonucleotide
  Description of Combined DNA/RNA Molecule: Synthetic oligonucleotide
ttcttagcaaaattgcctagt

SEQ ID NO: 5097 - DNA, 21 bp, Artificial Sequence
  Description of Artificial Sequence: Synthetic oligonucleotide
  Description of Combined DNA/RNA Molecule: Synthetic oligonucleotide
tcttagcaaaattgcctagta

SEQ ID NO: 5098 - DNA, 21 bp, Artificial Sequence
  Description of Artificial Sequence: Synthetic oligonucleotide
  Description of Combined DNA/RNA Molecule: Synthetic oligonucleotide
gcaaaattgcctagtatgtta

SEQ ID NO: 5099 - DNA, 21 bp, Artificial Sequence
  Description of Artificial Sequence: Synthetic oligonucleotide
  Description of Combined DNA/RNA Molecule: Synthetic oligonucleotide
aaaattgcctagtatgttaat

SEQ ID NO: 5100 - DNA, 21 bp, Artificial Sequence
  Description of Artificial Sequence: Synthetic oligonucleotide
  Description of Combined DNA/RNA Molecule: Synthetic oligonucleotide
aaattgcctagtatgttaatt

SEQ ID NO: 5101 - DNA, 21 bp, Artificial Sequence
  Description of Artificial Sequence: Synthetic oligonucleotide
  Description of Combined DNA/RNA Molecule: Synthetic oligonucleotide
cctagtatgttaatttgctca

SEQ ID NO: 5102 - DNA, 21 bp, Artificial Sequence
  Description of Artificial Sequence: Synthetic oligonucleotide
  Description of Combined DNA/RNA Molecule: Synthetic oligonucleotide
ctagtatgttaatttgctcaa

SEQ ID NO: 5103 - DNA, 21 bp, Artificial Sequence
  Description of Artificial Sequence: Synthetic oligonucleotide
  Description of Combined DNA/RNA Molecule: Synthetic oligonucleotide
tagtatgttaatttgctcaaa

SEQ ID NO: 5104 - DNA, 21 bp, Artificial Sequence
  Description of Artificial Sequence: Synthetic oligonucleotide
  Description of Combined DNA/RNA Molecule: Synthetic oligonucleotide
gttaatttgctcaaaatacaa

SEQ ID NO: 5105 - DNA, 21 bp, Artificial Sequence
  Description of Artificial Sequence: Synthetic oligonucleotide
  Description of Combined DNA/RNA Molecule: Synthetic oligonucleotide
ttaatttgctcaaaatacaat

SEQ ID NO: 5106 - DNA, 21 bp, Artificial Sequence
  Description of Artificial Sequence: Synthetic oligonucleotide
  Description of Combined DNA/RNA Molecule: Synthetic oligonucleotide
aatttgctcaaaatacaatgt

SEQ ID NO: 5107 - DNA, 21 bp, Artificial Sequence
  Description of Artificial Sequence: Synthetic oligonucleotide
  Description of Combined DNA/RNA Molecule: Synthetic oligonucleotide
ctcaaaatacaatgtttgatt

SEQ ID NO: 5108 - DNA, 21 bp, Artificial Sequence
  Description of Artificial Sequence: Synthetic oligonucleotide
  Description of Combined DNA/RNA Molecule: Synthetic oligonucleotide
caaaatacaatgtttgatttt

SEQ ID NO: 5109 - DNA, 21 bp, Artificial Sequence
  Description of Artificial Sequence: Synthetic oligonucleotide
  Description of Combined DNA/RNA Molecule: Synthetic oligonucleotide
aaaatacaatgtttgatttta

SEQ ID NO: 5110 - DNA, 21 bp, Artificial Sequence
  Description of Artificial Sequence: Synthetic oligonucleotide
  Description of Combined DNA/RNA Molecule: Synthetic oligonucleotide
caatgtttgattttatgcact

SEQ ID NO: 5111 - DNA, 21 bp, Artificial Sequence
  Description of Artificial Sequence: Synthetic oligonucleotide
  Description of Combined DNA/RNA Molecule: Synthetic oligonucleotide
aatgtttgattttatgcactt

SEQ ID NO: 5112 - DNA, 21 bp, Artificial Sequence
  Description of Artificial Sequence: Synthetic oligonucleotide
  Description of Combined DNA/RNA Molecule: Synthetic oligonucleotide
tttatgcactttgtcgctatt

SEQ ID NO: 5113 - DNA, 21 bp, Artificial Sequence
  Description of Artificial Sequence: Synthetic oligonucleotide
  Description of Combined DNA/RNA Molecule: Synthetic oligonucleotide
ctttgtcgctattaacatcct

SEQ ID NO: 5114 - DNA, 21 bp, Artificial Sequence
  Description of Artificial Sequence: Synthetic oligonucleotide
  Description of Combined DNA/RNA Molecule: Synthetic oligonucleotide
ctttttttcatgtagatttca

SEQ ID NO: 5115 - DNA, 21 bp, Artificial Sequence
  Description of Artificial Sequence: Synthetic oligonucleotide
  Description of Combined DNA/RNA Molecule: Synthetic oligonucleotide
tttttttcatgtagatttcaa

SEQ ID NO: 5116 - DNA, 21 bp, Artificial Sequence
  Description of Artificial Sequence: Synthetic oligonucleotide
  Description of Combined DNA/RNA Molecule: Synthetic oligonucleotide
ttcatgtagatttcaataatt

SEQ ID NO: 5117 - DNA, 21 bp, Artificial Sequence
  Description of Artificial Sequence: Synthetic oligonucleotide
  Description of Combined DNA/RNA Molecule: Synthetic oligonucleotide
tcatgtagatttcaataattg

SEQ ID NO: 5118 - DNA, 21 bp, Artificial Sequence
  Description of Artificial Sequence: Synthetic oligonucleotide
  Description of Combined DNA/RNA Molecule: Synthetic oligonucleotide
catgtagatttcaataattga

SEQ ID NO: 5119 - DNA, 21 bp, Artificial Sequence
  Description of Artificial Sequence: Synthetic oligonucleotide
  Description of Combined DNA/RNA Molecule: Synthetic oligonucleotide
atgtagatttcaataattgag

SEQ ID NO: 5120 - DNA, 21 bp, Artificial Sequence
  Description of Artificial Sequence: Synthetic oligonucleotide
  Description of Combined DNA/RNA Molecule: Synthetic oligonucleotide
tgtagatttcaataattgagt

SEQ ID NO: 5121 - DNA, 21 bp, Artificial Sequence
  Description of Artificial Sequence: Synthetic oligonucleotide
  Description of Combined DNA/RNA Molecule: Synthetic oligonucleotide
gtagatttcaataattgagta

SEQ ID NO: 5122 - DNA, 21 bp, Artificial Sequence
  Description of Artificial Sequence: Synthetic oligonucleotide
  Description of Combined DNA/RNA Molecule: Synthetic oligonucleotide
tagatttcaataattgagtaa

SEQ ID NO: 5123 - DNA, 21 bp, Artificial Sequence
  Description of Artificial Sequence: Synthetic oligonucleotide
  Description of Combined DNA/RNA Molecule: Synthetic oligonucleotide
agatttcaataattgagtaat

SEQ ID NO: 5124 - DNA, 21 bp, Artificial Sequence
  Description of Artificial Sequence: Synthetic oligonucleotide
  Description of Combined DNA/RNA Molecule: Synthetic oligonucleotide
caataattgagtaattttaga

SEQ ID NO: 5125 - DNA, 21 bp, Artificial Sequence
  Description of Artificial Sequence: Synthetic oligonucleotide
  Description of Combined DNA/RNA Molecule: Synthetic oligonucleotide
aattgagtaattttagaagca

SEQ ID NO: 5126 - DNA, 21 bp, Artificial Sequence
  Description of Artificial Sequence: Synthetic oligonucleotide
  Description of Combined DNA/RNA Molecule: Synthetic oligonucleotide
attgagtaattttagaagcat

SEQ ID NO: 5127 - DNA, 21 bp, Artificial Sequence
  Description of Artificial Sequence: Synthetic oligonucleotide
  Description of Combined DNA/RNA Molecule: Synthetic oligonucleotide
tgagtaattttagaagcatta

SEQ ID NO: 5128 - DNA, 21 bp, Artificial Sequence
  Description of Artificial Sequence: Synthetic oligonucleotide
  Description of Combined DNA/RNA Molecule: Synthetic oligonucleotide
taattttagaagcattatttt

SEQ ID NO: 5129 - DNA, 21 bp, Artificial Sequence
  Description of Artificial Sequence: Synthetic oligonucleotide
  Description of Combined DNA/RNA Molecule: Synthetic oligonucleotide
tttagaagcattattttagga

SEQ ID NO: 5130 - DNA, 21 bp, Artificial Sequence
  Description of Artificial Sequence: Synthetic oligonucleotide
  Description of Combined DNA/RNA Molecule: Synthetic oligonucleotide
tagaagcattattttaggaat

SEQ ID NO: 5131 - DNA, 21 bp, Artificial Sequence
  Description of Artificial Sequence: Synthetic oligonucleotide
  Description of Combined DNA/RNA Molecule: Synthetic oligonucleotide
agcattattttaggaatatat

SEQ ID NO: 5132 - DNA, 21 bp, Artificial Sequence
  Description of Artificial Sequence: Synthetic oligonucleotide
  Description of Combined DNA/RNA Molecule: Synthetic oligonucleotide
cattattttaggaatatatag

SEQ ID NO: 5133 - DNA, 21 bp, Artificial Sequence
  Description of Artificial Sequence: Synthetic oligonucleotide
  Description of Combined DNA/RNA Molecule: Synthetic oligonucleotide
taggaatatatagttgtcaca

SEQ ID NO: 5134 - DNA, 21 bp, Artificial Sequence
  Description of Artificial Sequence: Synthetic oligonucleotide
  Description of Combined DNA/RNA Molecule: Synthetic oligonucleotide
aggaatatatagttgtcacag

SEQ ID NO: 5135 - DNA, 21 bp, Artificial Sequence
  Description of Artificial Sequence: Synthetic oligonucleotide
  Description of Combined DNA/RNA Molecule: Synthetic oligonucleotide
ggaatatatagttgtcacagt

SEQ ID NO: 5136 - DNA, 21 bp, Artificial Sequence
  Description of Artificial Sequence: Synthetic oligonucleotide
  Description of Combined DNA/RNA Molecule: Synthetic oligonucleotide
aatatatagttgtcacagtaa

SEQ ID NO: 5137 - DNA, 21 bp, Artificial Sequence
  Description of Artificial Sequence: Synthetic oligonucleotide
  Description of Combined DNA/RNA Molecule: Synthetic oligonucleotide
atatatagttgtcacagtaaa

SEQ ID NO: 5138 - DNA, 21 bp, Artificial Sequence
  Description of Artificial Sequence: Synthetic oligonucleotide
  Description of Combined DNA/RNA Molecule: Synthetic oligonucleotide
tagttgtcacagtaaatatct

SEQ ID NO: 5139 - DNA, 21 bp, Artificial Sequence
  Description of Artificial Sequence: Synthetic oligonucleotide
  Description of Combined DNA/RNA Molecule: Synthetic oligonucleotide
agttgtcacagtaaatatctt

SEQ ID NO: 5140 - DNA, 21 bp, Artificial Sequence
  Description of Artificial Sequence: Synthetic oligonucleotide
  Description of Combined DNA/RNA Molecule: Synthetic oligonucleotide
gtaaatatcttgttttttcta

SEQ ID NO: 5141 - DNA, 21 bp, Artificial Sequence
  Description of Artificial Sequence: Synthetic oligonucleotide
  Description of Combined DNA/RNA Molecule: Synthetic oligonucleotide
taaatatcttgttttttctat

SEQ ID NO: 5142 - DNA, 21 bp, Artificial Sequence
  Description of Artificial Sequence: Synthetic oligonucleotide
  Description of Combined DNA/RNA Molecule: Synthetic oligonucleotide
atcttgttttttctatgtaca

SEQ ID NO: 5143 - DNA, 21 bp, Artificial Sequence
  Description of Artificial Sequence: Synthetic oligonucleotide
  Description of Combined DNA/RNA Molecule: Synthetic oligonucleotide
tcttgttttttctatgtacat

SEQ ID NO: 5144 - DNA, 21 bp, Artificial Sequence
  Description of Artificial Sequence: Synthetic oligonucleotide
  Description of Combined DNA/RNA Molecule: Synthetic oligonucleotide
cttgttttttctatgtacatt

SEQ ID NO: 5145 - DNA, 21 bp, Artificial Sequence
  Description of Artificial Sequence: Synthetic oligonucleotide
  Description of Combined DNA/RNA Molecule: Synthetic oligonucleotide
ttgttttttctatgtacattg

SEQ ID NO: 5146 - DNA, 21 bp, Artificial Sequence
  Description of Artificial Sequence: Synthetic oligonucleotide
  Description of Combined DNA/RNA Molecule: Synthetic oligonucleotide
ttctatgtacattgtacaaat

SEQ ID NO: 5147 - DNA, 21 bp, Artificial Sequence
  Description of Artificial Sequence: Synthetic oligonucleotide
  Description of Combined DNA/RNA Molecule: Synthetic oligonucleotide
tctatgtacattgtacaaatt

SEQ ID NO: 5148 - DNA, 21 bp, Artificial Sequence
  Description of Artificial Sequence: Synthetic oligonucleotide
  Description of Combined DNA/RNA Molecule: Synthetic oligonucleotide
atttttcattccttttgctct

SEQ ID NO: 5149 - DNA, 21 bp, Artificial Sequence
  Description of Artificial Sequence: Synthetic oligonucleotide
  Description of Combined DNA/RNA Molecule: Synthetic oligonucleotide
tggttggatctaacactaact

SEQ ID NO: 5150 - DNA, 21 bp, Artificial Sequence
  Description of Artificial Sequence: Synthetic oligonucleotide
  Description of Combined DNA/RNA Molecule: Synthetic oligonucleotide
ggttggatctaacactaactg

SEQ ID NO: 5151 - DNA, 21 bp, Artificial Sequence
  Description of Artificial Sequence: Synthetic oligonucleotide
  Description of Combined DNA/RNA Molecule: Synthetic oligonucleotide
ttggatctaacactaactgta

SEQ ID NO: 5152 - DNA, 21 bp, Artificial Sequence
  Description of Artificial Sequence: Synthetic oligonucleotide
  Description of Combined DNA/RNA Molecule: Synthetic oligonucleotide
ctgtattgttttgttacatca

SEQ ID NO: 5153 - DNA, 21 bp, Artificial Sequence
  Description of Artificial Sequence: Synthetic oligonucleotide
  Description of Combined DNA/RNA Molecule: Synthetic oligonucleotide
tgtattgttttgttacatcaa

SEQ ID NO: 5154 - DNA, 21 bp, Artificial Sequence
  Description of Artificial Sequence: Synthetic oligonucleotide
  Description of Combined DNA/RNA Molecule: Synthetic oligonucleotide
gtattgttttgttacatcaaa

SEQ ID NO: 5155 - DNA, 21 bp, Artificial Sequence
  Description of Artificial Sequence: Synthetic oligonucleotide
  Description of Combined DNA/RNA Molecule: Synthetic oligonucleotide
attgttttgttacatcaaata

SEQ ID NO: 5156 - DNA, 21 bp, Artificial Sequence
  Description of Artificial Sequence: Synthetic oligonucleotide
  Description of Combined DNA/RNA Molecule: Synthetic oligonucleotide
tctgtggaccaggcaaaaaaa

SEQ ID NO: 5157 - DNA, 21 bp, Artificial Sequence
  Description of Artificial Sequence: Synthetic oligonucleotide
  Description of Combined DNA/RNA Molecule: Synthetic oligonucleotide
ctgtggaccaggcaaaaaaaa

SEQ ID NO: 5158 - DNA, 21 bp, Artificial Sequence
  Description of Artificial Sequence: Synthetic oligonucleotide
  Description of Combined DNA/RNA Molecule: Synthetic oligonucleotide
accaggcaaaaaaaaaaaaaa

SEQ ID NO: 5159 - DNA, 21 bp, Artificial Sequence
  Description of Artificial Sequence: Synthetic oligonucleotide
  Description of Combined DNA/RNA Molecule: Synthetic oligonucleotide
cactttttcaagcagtaggaa

SEQ ID NO: 5160 - DNA, 21 bp, Artificial Sequence
  Description of Artificial Sequence: Synthetic oligonucleotide
  Description of Combined DNA/RNA Molecule: Synthetic oligonucleotide
actttttcaagcagtaggaat

SEQ ID NO: 5161 - DNA, 21 bp, Artificial Sequence
  Description of Artificial Sequence: Synthetic oligonucleotide
  Description of Combined DNA/RNA Molecule: Synthetic oligonucleotide
ttcaagcagtaggaattattt

SEQ ID NO: 5162 - DNA, 21 bp, Artificial Sequence
  Description of Artificial Sequence: Synthetic oligonucleotide
  Description of Combined DNA/RNA Molecule: Synthetic oligonucleotide
agcagtaggaattatttagca

SEQ ID NO: 5163 - DNA, 21 bp, Artificial Sequence
  Description of Artificial Sequence: Synthetic oligonucleotide
  Description of Combined DNA/RNA Molecule: Synthetic oligonucleotide
cagtaggaattatttagcatg

SEQ ID NO: 5164 - DNA, 21 bp, Artificial Sequence
  Description of Artificial Sequence: Synthetic oligonucleotide
  Description of Combined DNA/RNA Molecule: Synthetic oligonucleotide
agtaggaattatttagcatgt

SEQ ID NO: 5165 - DNA, 21 bp, Artificial Sequence
  Description of Artificial Sequence: Synthetic oligonucleotide
  Description of Combined DNA/RNA Molecule: Synthetic oligonucleotide
gtaggaattatttagcatgta

We claim:

1. An isolated double stranded nucleic acid (dsNA) comprising first and second nucleic acid strands comprising RNA, wherein said first strand is 15-35 nucleotides in length and said second strand of said dsNA is 19-35 nucleotides in length, wherein said second oligonucleotide strand is sufficiently complementary to SEQ ID NO: 1807 along at least 19 nucleotides of said second oligonucleotide strand length to reduce HIF-1α target mRNA expression when said double stranded nucleic acid is introduced into a mammalian cell.

2. An isolated dsNA molecule, comprising: (a) a sense region and an antisense region, wherein said sense region and said antisense region together form a duplex region consisting of 25-35 base pairs and said antisense region comprises a sequence that is the complement of SEQ ID NO: 1807; and (b) from zero to two 3' overhang regions, wherein each overhang region is six or fewer nucleotides in length, and wherein the dsNA molecule reduces HIF-1α mRNA expression when the dsNA is introduced into a mammalian cell.

3. An isolated double stranded ribonucleic acid (dsNA) comprising first and second nucleic acid strands and a duplex region of at least 25 base pairs, wherein said first strand is 25-50 nucleotides in length and said second strand of said dsNA is 25-50 nucleotides in length and comprises 1-5 single-stranded nucleotides at its 3' terminus and said second oligonucleotide strand is sufficiently complementary to SEQ ID NO: 1807 along at least 19 nucleotides of said second oligonucleotide strand length to reduce HIF-1α target gene expression when said double stranded nucleic acid is introduced into a mammalian cell.

4. The isolated dsNA of claim 1 comprising a duplex region selected from the group consisting of at least 25 base pairs, 19-21 base pairs and 21-25 base pairs.

5. The isolated dsNA of claim 1, wherein said second oligonucleotide strand comprises 1-5 single-stranded nucleotides at its 3' terminus.

6. The isolated dsNA of claim 1, wherein said first strand and/or said second strand is 25-35 nucleotides in length.

7. The isolated dsNA of claim 1, wherein said second oligonucleotide strand is complementary to SEQ ID NO: 1343 along at least 21 nucleotides of said second oligonucleotide strand length.

8. The isolated dsNA of claim 1, wherein starting from the first nucleotide (position 1) at the 3' terminus of the first oligonucleotide strand, position 1, 2 and/or 3 is substituted with a modified nucleotide.

9. The isolated dsNA of claim 1, wherein said 3' terminus of said first strand and said 5' terminus of said second strand form a blunt end.

10. The isolated dsNA of claim 1, wherein said first strand is 25 nucleotides in length and said second strand is 27 nucleotides in length.

11. The isolated dsNA of claim 1, comprising a modified nucleotide.

12. The isolated dsNA of claim 3, wherein, starting from the 5' end of SEQ ID NO: 1343, mammalian Ago2 cleaves said mRNA at a site between positions 9 and 10 of said sequence, thereby reducing HIF-1α target mRNA expression when said double stranded nucleic acid is introduced into a mammalian cell.

13. The isolated dsNA of claim 1, wherein said second strand comprises SEQ ID NO: 178, and/or wherein said first strand comprises SEQ ID NO: 556.

14. The isolated dsNA of claim 1 comprising a tetraloop.

15. The isolated dsNA of claim 1 comprising a 2'-O-methyl nucleotide.

16. The isolated dsNA of claim 1, wherein said second oligonucleotide strand comprises a modification pattern selected from the group consisting of AS-M1 to AS-M40 and AS-M1* to AS-M40*, and/or wherein said first oligonucleotide strand comprises a modification pattern selected from the group consisting of SM1 to SM16.

17. The isolated dsNA of claim 1, wherein said dsNA is cleaved endogenously in said cell by Dicer.

18. A method for reducing expression of a target HIF-1α gene in a mammalian cell comprising contacting a mammalian cell in vitro with an isolated dsNA of claim 1 in an amount sufficient to reduce expression of a target HIF-1α mRNA in said cell.

19. A method for reducing expression of a target HIF-1α mRNA in a mammal comprising administering an isolated dsNA of claim 1 to a mammal in an amount sufficient to reduce expression of a target HIF-1α mRNA in the mammal.

20. A method for selectively inhibiting the growth of a cell comprising contacting a cell with an amount of an isolated dsNA of claim 1 sufficient to inhibit the growth of the cell.

21. A formulation comprising the isolated dsNA of claim 1, wherein said dsNA is present in an amount effective to reduce target HIF-1α mRNA levels when said dsNA is introduced into a mammalian cell in vitro by an amount (expressed by %) selected from the group consisting of at least 10%, at least 50% and at least 80-90%.

22. An isolated mammalian cell containing the isolated dsNA of any of claim 1.

23. A pharmaceutical composition comprising the isolated dsNA of claim 1 and a pharmaceutically acceptable carrier.

24. A kit comprising the isolated dsNA of claim 1 and packaging materials therefore.

25. A method for treating or preventing a HIF-1α-associated disease or disorder in a subject comprising administering the isolated dsNA of claim 1 and a pharmaceutically acceptable carrier to the subject in an amount sufficient to treat or prevent said HIF-1α-associated disease or disorder in said subject, thereby treating or preventing said HIF-1α-associated disease or disorder in said subject.

26. A composition possessing HIF-1α inhibitory activity consisting essentially of an isolated double stranded nucleic acid (dsNA) of claim 1.

* * * * *